United States Patent 7,557,201 (NUCLEIC ACID MOLECULES AND OTHER MOLECULES ASSOCIATED WITH PLANTS) - sequence listing, part 5

SEQ ID NO: 25288 - DNA, 408 bp, Gossypium hirsutum
  Clone ID: LIB3272-048-P1-K1-F1
aatcaatccaaccaaatcccaccatcaaaatccccgtaggggacccattcaacgatccgacggctagctttcactccgttaactttaactacaacaatgcagtcagtagtccttgccccgtcgattacctcgggtctctccaccgttacctaccgtcaaacgactacgagtccgattcgctgagtgatgattcggacttacctgttgatgcattctcatgcgaccatttccggatgtacgagttcaaggtgaggaggtgtgctcgtggaaggtcacatgactggactgagtgtccgtacgctcaccctggtgagaaggcccgaagaagggacccgagaaagttccattactctggaactgcttggcccgattttcgcaagggaagctgttagaaaagcgattcatgtg

SEQ ID NO: 25289 - DNA, 341 bp, Gossypium hirsutum
  Clone ID: LIB3272-048-P1-K1-F11
aaaaattcaggttgggagtattacacagctttgttttggttaactccttttcgtccaccatatttgcccccaatatgaagatcttgttctcgaaagttctaacgaacaccgatatacagaaaagattggcggttcccaacaattcactgaagcatttcgagcttgaaaatggtaattgctccaaatcatttgaagttaaagatgaaaacggattcacatggccttttcgttgctatgttcgtaacgacggtgcctacaagaagcctgttttatccagcggttggcgtcaatttgtccttaataaaggagttcaccagggggatttgattacactctataag

SEQ ID NO: 25290 - DNA, 391 bp, Gossypium hirsutum
  Clone ID: LIB3272-048-P1-K1-F12
ctgtatcttagttcttgattaattagccaatcacagcagccatgtctctcctcaatgatctcatcaacctcaacctcggcgacgccactgaaaagatcatagccgaatacatatggatcggtggatctggaatggatctgagaagcaaagcaaggactttgcctggaccagtggcggacccttcaaaactcccgaagtggaactacgatggttccagtaccaatcaagcacctggagatgacagtgaggtcattctttatcctcaagctatattcaaggatccatttagaaaaggaaacaacatcttggtgatgtgcgatgcttacacaccagccggcgaacccattcctaccaacaagagatttaatgcggccaagatctttagccaccc

SEQ ID NO: 25291 - DNA, 362 bp, Gossypium hirsutum
  Clone ID: LIB3272-048-P1-K1-F2
atcagtatcacttgtaagctttacagggaaaaagggggaaaaaaagtgcggatcaagcatagatggaaaacatgggagttttaggcaaggtggtggattaccttctattgttatcattctttagcatcacattaacagctcagttggacatccccgagtccatcctcccccacgcctacaatcccttctatcaagtttataccacgttaacccaggattatttggtgcttgagcagcctggttttttcaaggcacttatgacgttggaacttgtttaccaactccctctcgctttgcttaacatctatggattgttatactccaagccctggttcaacaccacctgcctcctctttggtgcc

SEQ ID NO: 25292 - DNA, 407 bp, Gossypium hirsutum
  Clone ID: LIB3272-048-P1-K1-F6
tgcaagtgttagggtcagcaacgagctcggatcggaacatcccaagtcggcggcattcacggttgctgtcgtgactttggtctccctcataattgctgtagtggaagctgtcattgtatttgctctgcgagatgttataagctatgcatttacggaaggtgagacggtggcaaaagcagtctcggacctatgcccattcttggctgtcactcttatccttaatgggattcaacctgtcttgtctggggtggctgttggatgtggatggcaagcatttgtagcctatgtaaacgtgggatgctattacgtagttgggattcccttgggctgtgttctcggattcaagtacgacctcggtgcaaagggaatatggtccgggatgataggaggaacaatgatgcaaaccc

SEQ ID NO: 25293 - DNA, 368 bp, Gossypium hirsutum
  Clone ID: LIB3272-048-P1-K1-F7
cggttctccgatccctctccccatcaggccgattcagttctcactatgggggacactctccggcttgtgcttcctcggcttttgcttattccagttcgagctttacttcacgctcttctactttctttaatcaacctagatctatttctccaccgcgcgtcaatgtttataaccacactcaatcgtcgcagtctgttcgattctcgctcgatagccggccgatctcgccgaatcgttcgatttcagctgtccgtagaaacaccgaggcgttgagaaatttacagagcaaacagccaaagcgtacctgtatgtgttcccctacgacgcattctggatcggttcgttgcagtcttcataaaggattcaat

SEQ ID NO: 25294 - DNA, 386 bp, Gossypium hirsutum
  Clone ID: LIB3272-048-P1-K1-F9
atcaaatcaaaagagagaaaaaagaaatccccaaatctgaaccctaaaagatggcgaagatatggggaaagatgtgggctttgatgggtttgcttctttttaattcggtgtgtaatgtttcctccctttcggtgaatgtaaacaacatcgaatgtgtgtacgaatatgtgctttacgaaggagacacgatttccggcaactttgtcgtcgttgaccatgatattttctggggttccgaccaccctggcattgatttcactgtgagttctcctctgggtaatacagttcacgaattgaaggggacatctggggacaagtttgaagtcaaagccccaagaagcggaatgtacaaattttgttttcacaatccccactctgcaccagag

SEQ ID NO: 25295 - DNA, 409 bp, Gossypium hirsutum
  Clone ID: LIB3272-048-P1-K1-G1
gggagtgggagccgaatagtgtttccttgtagagccttctcactggcattcctagtcccttctttcacttcctcaactcaactcagcctcaaatctttcctcgcccacacctctcttccccccactgccttctcttttctccgaatggcttcctcatcatcttcttccctcaccaacggtaacgatatcaatccttccaatgacgctgctgccccttctcccccctccgcttcctctgccatcgattttctcactctctgtcatcgcctcaagacgacgaaacgagcggggtgggtgcggagagatgtacagaatccggaatcaatagctgatcatatgtatcgaatgggattaatggctttaattgcttctgatattcctggaattgatcaagacaagtgtgttaaaa

SEQ ID NO: 25296 - DNA, 388 bp, Gossypium hirsutum
  Clone ID: LIB3272-048-P1-K1-G10
cttcccctttccctccaactttaatctaccacaactgtaacgacgccatggttcacgtcagtttctaccgtaactatgggaagacctttaagaagccaagacgtccatatgagaaagaacgattagatgcagagttgaggcttgtaggagagtatgggctccgatgtaagagggagttgtggagggttcagtatgctttgagccgtatccgtaatgctgctagggaccttctcacccttgatgagaagaaccctcgtcgtatttttgaaggtgaagctcttcttcgtaggatgaacaggtatggacttttggatgagagccagaacaagcttgattatgtcttggctttgaccgtcgagaacttccttgaacgccgcttgcaaacact

SEQ ID NO: 25297 - DNA, 398 bp, Gossypium hirsutum
  Clone ID: LIB3272-048-P1-K1-G11
gcctcactcgccgtctcgcctctcgcttattggttcaagatctggttttgatctgatcagatcggataaaaatatcaaaacatgtttgggagagcaccgaataaaagcgataataccaaatactatgagattttgggagtatcgaaaaacgcttctcaagatgatctaaagaaagcttatagaaaagccgctattaagaatcataccgataaaggcggcgatcctgaaaagtttaaagagttggctcaagcttatgaggtgctgagtgacccggagaagcgtgagatttatgatcagtatggtgaggactcccttaaagaatggatgggcagccgtcgcggtggccatgaccctttcgatatcttccagacattctttggtggcaatccttttggtgc

SEQ ID NO: 25298 - DNA, 357 bp, Gossypium hirsutum
  Clone ID: LIB3272-048-P1-K1-G12
ctctgctcgaaatcttcttcattctcattctctctccactgaactcttgctaaacggtatcgttttagtcagtctttcatcaatggcgaaagaaccagttcgcgtcctcgttactggagctgcaggacaaatcgggtatgctcttgtacccatgattgctaggggagtcatgttgggtgctgaccagcccgtgatccttcacatgcttgatatcccacctgctgcggaggctttgaatggtgtcaaaatggagttggtggatgctgcatttcctcttctaaagggtgttgttgctacaactgatgctgttgaggcatgcactggagtcaatgttgctgtcatggttggtggtttccc

SEQ ID NO: 25299 - DNA, 411 bp, Gossypium hirsutum
  Clone ID: LIB3272-048-P1-K1-G2
aatcgatccaaccagatcccaccatcaaaatccccgtaggggacccattcagcgatgcgacggctcgctttcactccgttaactttaactacaacaatgcaggcagtggtccttgccccgtcgattacgtggggtctctccaccgttacctaccggcaaacgactacgagtccgattcgctgagtgatgattcggacttacctgttgatgcattctcatgcgaccatttccggatgtaccagttcaaggagaggaggtgttctcgtggaaggtcacatgactggactgagggtccgcacgctcaccctggtgagaaggccctaagaagggacccgagaaagttccattactctggaactgctagcccctattatcgcaaggggagctgtaagaaaggcgattcatgtcaat

SEQ ID NO: 25300 - DNA, 355 bp, Gossypium hirsutum
  Clone ID: LIB3272-048-P1-K1-G3
gttttgaatctagggatttgcgggtggagaagacgagagctcatctctctgcttcaaagctcctgtccaggtagaattctcttcttcctttgcgttgtgttctttgttgttcagtcgccatggcttcaaagcggattttgaaggaactcaaggatttgcagaaagatccacccacttcttgcagtgctggtccagtagctgaagacatgtttcattggcaagcaacaatcatgggaccctcagatagcccttatgctggaggtgtgtttttagttaccatccatttccctccagattatcctttcaagccttctaaggtcacgtttaggaccaagggttttcatcctaacattaa

SEQ ID NO: 25301 - DNA, 412 bp, Gossypium hirsutum
  Clone ID: LIB3272-048-P1-K1-G4
caattttctcccttactaacaacaaaaaccctgaaatgtcggacgacgatcatcatgtcgaatccaaggctgatgccggcgcctccaaaacctatcctcagcaagccggtactatccgtaagaacggctatatcgtcattaaaggccgtccctgcaaggttgtggaagtttccacctccaagacggggaagcacggtcatgctaagtgtcacttcgttgggatcgatatcttcactggcaagaagttggaagatattgttccctcctcccataactgtgatgttccgcatgtcaatcgtactgactaccaattgattgacatttctgaggatggatttgtgagcttgctgactgatagtggggatactaaagacgatctcaggctcccaactgatgagaacttgttgaaaca

SEQ ID NO: 25302 - DNA, 364 bp, Gossypium hirsutum
  Clone ID: LIB3272-048-P1-K1-G6
gctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggactttgaaaagagagtc

SEQ ID NO: 25303 - DNA, 396 bp, Gossypium hirsutum
  Clone ID: LIB3272-048-P1-K1-G7
ggagagggagctgctgcatttgttcgacgccgccaaaaaagctgccgatttggccgcctccgacgccgtttcctccaacgcccctgaagtttccagatgcgttgacgccttgaaccagcttaaggatttccccgtcacttatgacactcttgtttctacacaggttggaaaaaagctgcgacctctcactaagcatcctagagagaaaatcaagactgtggcttctgacttgcttgagttgtggaagaaaattgttattgaggagactaccaagagtaagaaaaatggcaccactagtgctgtcaaggttgagaaacttcctaagccaagtgctgtaaagtctgaaaaactctacaatacagaatctgtgaaggttgagagatctaaaggtgattc

SEQ ID NO: 25304 - DNA, 393 bp, Gossypium hirsutum
  Clone ID: LIB3272-048-P1-K1-G8
gtttctctctctttctctctccagaaagggcaaaacaaccctgaagaaccgggtacacccccaatagctccatggacgaggatgcgttgaacatgcgtaattggggctactatgaaccgtcttttaaaggacatcttggtcttcatctaatggctgagcgggacaaaaagcctttcattcctgggcgtgaccccaacaatctcatggttactaccaatgcttttcacccaagggactgcattgtctctgaggcacctcctatccgcatgcaatatgttagggatacttggattagccagagagagaagcttttcaacatgttgcctcctgtcactgccccgaattacgacattctttcagaaacttcggctactcattccatgccaatttggc

SEQ ID NO: 25305 - DNA, 385 bp, Gossypium hirsutum
  Clone ID: LIB3272-048-P1-K1-G9
gttttgtatttcatactcatttagcccctttcattagcatcgaaatcactccagttttctttatcactgaaaaatgtcttgctgtggtggaaactgtggctgcggttctggctgcaagtgtggcagtggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagagacgcctttgtctttaaaaaataatatgttttggtcgttat

SEQ ID NO: 25306 - DNA, 366 bp, Gossypium hirsutum
  unsure (1)..(366): unsure at all n locations
  Clone ID: LIB3272-048-P1-K1-H1
aatctcctctgcctattggagattacagcaaaaggctttttttttttttcattataattttacaagtgtaaaaatccccttggggaatgcagagagatgagacgttcatcgttggcaaggcctgagctttgttaccaccgtaagcgctccatcggcggccgaaattgtcaccgaaaacacgtcgaagacgggtgattcagtttgaaggctttcaagtttaaatatacatatatttctcacttataattgaaatatacagtacttcaaatcaaagggtatccggntcttttcttaattttctttttaaattctcgagcttttattggtcaaaaatggcggacaaagcttaaacccgaaacccatttt

SEQ ID NO: 25307 - DNA, 115 bp, Gossypium hirsutum
  Clone ID: LIB3272-048-P1-K1-H10
aacccctcaaagcctatttacttatacatcaattcatctgggacacagaatgagaagatggagactgttggatcagaaaccgaggcatatgctatagctgacaccatggcttact

SEQ ID NO: 25308 - DNA, 174 bp, Gossypium hirsutum
  Clone ID: LIB3272-048-P1-K1-H11
tttcttttgtagtggaagaaaaaaaagagaaaaaattatggagacaaagtcattggcaatggtggtggtgataactgtttcagtcatgtggggcgttgaaatggccactgcagaactcagtgccgatcagtgcaagcaagaaaggaacctcgacattaccggttgcaagccggt

SEQ ID NO: 25309 - DNA, 152 bp, Gossypium hirsutum
  unsure (1)..(152): unsure at all n locations
  Clone ID: LIB3272-048-P1-K1-H12
gcttcggccctttacagccaaatacctttctcgagcgtttcttttttaactctccagttctccacgaatccatagaatttcaccaagaagaagaagaagatgtcgtggcaaacatatgtagatgagcactngatgtgcgaaatcgatggcaa

SEQ ID NO: 25310 - DNA, 411 bp, Gossypium hirsutum
  Clone ID: LIB3272-048-P1-K1-H2
ctcatcctctaccaacgattaccaattgtttctgttacagatttctactttttcttctgataatgatatcaaggcaccaaagaaacaatatggattagaaggaggtggtaattcaaagatgaagggcaatggaagcattagtggcaaagacttgatctttagaggtgatcaaattgatttaaaaagcttagacatgcagctggagaagcacctgagccgagtttggtctaggaacattgagaaacaaaggccagctgaggaatggcagattgatttggctaagtcgcatttaaggaatgatatagctcatggcacctatgggactgtttatcgtgccacttatgataaccaaaatgttgcacgaacactgaccagatgaggaaatacaaaatgaagcagatgaaaggcttt

SEQ ID NO: 25311 - DNA, 389 bp, Gossypium hirsutum
  Clone ID: LIB3272-048-P1-K1-H3
ggttttcggcggctaacggtgcaaatttcaccttccggggtttttttgagctgtacccatgtcaaagctcttttcttttagtggaactgatgatttttgccctggggggtcgatctacacaaaccccaaggaatcaagtctctttttgtcccttggacgtcatgtggatgtatattttccctatcgcaagaggtcccgcatcagtgcgccttttgttttctctggagagaggtctgagaagaacaaatcatcaattgaggttctccctgatgaatgcttattcgaaattttgagacgattaccagggggacaagagaggagtttctgcgcttgtgtcttcaggcgttggcttacaattgtaagcaacatccgcagcaatgaaatcagtg

SEQ ID NO: 25312 - DNA, 235 bp, Gossypium hirsutum
  Clone ID: LIB3272-048-P1-K1-H4
acgggaattgttcgtcgccgccgagggtatgtacaccggacagttcgtgtattgtggtgaggaaagctacccttgtgggtggaaatgtgttgccccttagatctatccctgaaggagctgtcgtttgcaacgttgagcaccatgttggtgaccgtggggttttcgctagagcttctggggattatgctattgttattagtcacaaccctgataatgataccaccaggatcaagct

SEQ ID NO: 25313 - DNA, 128 bp, Gossypium hirsutum
  Clone ID: LIB3272-048-P1-K1-H6
caaagctaaacctctctcagctttttatatattcctcctttttttctatcaaaatcaaaatggcttctttccttactcaaagtgtcctcaaacttttcctcgtcatctcttttgtttcaaattttttt

SEQ ID NO: 25314 - DNA, 371 bp, Gossypium hirsutum
  Clone ID: LIB3272-048-P1-K1-H7
gaacccgaaaagtagagctttggttctctgtctgctgcttctttcttctcttggtacttcattatttttcctttcacttcctttttgtgaaaaaacattgaaacccttttcaagacgcaatagaagatgtgtggaggtgcaatcatttccgatttcattgccgtgaaacgcggtcggaagttaaccgccgaggatctttggtctgaacttgacacattctccgacctgttgggtctggattacggaaatggaaaagaccctttcactcagttcgacaacaccaaggccggttccaaagccaagaaccttgaaaaagtgacaaacgagtcgactcaaaagacaagccgggggagagagaaagaagggaagac

SEQ ID NO: 25315 - DNA, 402 bp, Gossypium hirsutum
  Clone ID: LIB3272-048-P1-K1-H8
cttttgggcaatcaattttgtaagcaagtatggctaaggacgttgaggttggtggtgagttccaagccaaggactaccatgatcctccaccagctccattagtggacggggaggagttgacaaagtggtcattttatagggctgtaatagccgagtttattgccacgctcttatttttatacatcactgtgttgacagtgatcggatacaagagtcaggttgaccctgataagggcagagacgaatgcggtggtgttggcattcttggcattgcttgggcttttggtgggatgatctttatccttgtttactgcactgctggtatctctggaggacacatcaacccagcagtgacctttgggcttttcttggctaggaaggtgtccttagttcgagccatat

SEQ ID NO: 25316 - DNA, 393 bp, Gossypium hirsutum
  Clone ID: LIB3272-048-P1-K1-H9
tgtagattcacctctaaattgcttaccccaaatccttaggtttcttttcttattctttttcccattatccttctttccttggtctagactttagtgtcctttgtttctaattgtctaacttggattagcccctttgtttctttttacaacctagtctaaattagccatcctagatgttctttctttgtcttgcaactcttttcctctctccagcattgccttcaattggctgcttaacaatcaaatatcctcaaaatactcttttcttttacttgggatttctcttcctcgccatctttttctgtttttttatgaaggaaaaggtaggaagggaaaaaagtaaagtggttatttgtcacctctgaagcttgttaggttaatcagttccatgtc

SEQ ID NO: 25317 - DNA, 387 bp, Gossypium hirsutum
  Clone ID: LIB3272-049-P1-K1-A1
cttaagtcttcccataaaacagagcagagaaggtcaaacccaaagtttgaaaaccatcaaaaatggttcaaaggctcacttaccgtactcgccatagctacgctaccaaatccaaccaacaccgtgtcgttaagacccctggtgggaaattggtctatcagacaactaagaaaagagcaagtgggcctaagtgtcctgtcactggcaagagaattcagggtattcctcacttgagacctgctgaatacaaaaggtctagattgccaaggaaccgccggactgtgaatcgtgcttatggtggtgttttgtcctgcagtgctgttagagagaggataattcgagccttcttggtggaagagcagaaaattgtgaagaaggttctgaaga

SEQ ID NO: 25318 - DNA, 391 bp, Gossypium hirsutum
  Clone ID: LIB3272-049-P1-K1-A10
aaagagcaggaaaacaagaaaagcagagccgcatcactttttgctagctaagctactgtgggagttattgttcttcagaacagcttctgcagtagctaataatatcgttatatattatataaattttatacatcctttttaccctacaactccatataagcaagtaaaaataaatatggctcgctctgtttcttcctttaagctccttggtgcttctatttttgatggtctttatgtctccatatcaaggagaggttactcgggtgcaccgccggcggcagtgacggctagctttggtaggcctggggcgatggggaaagtggaacgaagagatgcgatgaaagagtcgtcgtcgtcggagacaagggcttattcttcagcttgggcgcct

SEQ ID NO: 25319 - DNA, 388 bp, Gossypium hirsutum; identical to SEQ ID NO: 22279
  Clone ID: LIB3272-049-P1-K1-A11

SEQ ID NO: 25320 - DNA, 390 bp, Gossypium hirsutum
  Clone ID: LIB3272-049-P1-K1-A12
gggggtcacagtgattcagcaagagaaatgatggaaaaatcctatattggtgagattgatccaaaaactgtcccggcaaagcgcacttacattccaccccagcaaacgccttacaatcccgataagacccctgagtttgtcatcaagatcctacaatttcttgttcccctcttgatcctgggcttggctattgcggtacgtcactataccaagaaagagtagcttattactatacaggactttacctgttacgagggaagaatcagtgtgtctcatctgttagttgaaatagcacagtcatatcttttgtttaatttccttttagcatttgtgtgtcgaactaaatacctgttgatgatatgctccattgtcaaaagacaatatatttgt

SEQ ID NO: 25321 - DNA, 389 bp, Gossypium hirsutum
  Clone ID: LIB3272-049-P1-K1-A3
ctcagttatattcagataatattggtttcccattatgcagttcctacgattataatggtggcaatggtagtgatggtttcaattcatttcattttggtcctcaatggaaaccacagctacaatttcaagaacagcttcaaaatcatgagattgatgagttcatcaaatcacaggatgagagattgagattattattacaagaacaaagaaaccaacaagtttcaaccatggtgaaaaagcttgaatccaaggcatcttttttagaagaagagatcacaaaggccaaaaacagaacaatggagcttcaaattttaatgaataagctagaaatggagaaccaaacatggcaaagagtggcacaagagaatgaagccatggttgtctctttg

SEQ ID NO: 25322 - DNA, 388 bp, Gossypium hirsutum
  Clone ID: LIB3272-049-P1-K1-A4
gtactcactcaacattcccattttcaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatcttatgtggccacgtcaaccccgccgtcaccttctgtgctttcgttggcgggaacatcactctcttgcgcggcattctttactggatcgcccaactcctaggct

SEQ ID NO: 25323 - DNA, 387 bp, Gossypium hirsutum
  Clone ID: LIB3272-049-P1-K1-A5
tttcattttacaacccagtaaggggatatttttctcttctctttgaaaaatccgaaaagtaattttccaaagggaaacttttgctcgtaatattctcagatctgctctcaaatcgtcacattttgaatagccaatatgggaggcgggttcagagtacttcatttggttagaccatttctttcgtttctgcctgaagttcagagtgctgataggaaaatcccttttagagagaaggtcatctatactgtgatatccctctttattttcctggtttgcagtcagcttcccctttatggaatacattctacgacgggcgctgatccgttttattggatgcgtgttatccttgcatccaaccgtggaaccgttatggaacttgggattact

SEQ ID NO: 25324 - DNA, 383 bp, Gossypium hirsutum
  Clone ID: LIB3272-049-P1-K1-A6
atcaaccttgttgtcattggccatgtcgactctggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaaccactggtggttttgaagctggtatctctaaagatggtcagactcgtga

SEQ ID NO: 25325 - DNA, 386 bp, Gossypium hirsutum
  Clone ID: LIB3272-049-P1-K1-A7
ctgacattggttgagtacatgatgctactttaccgtgctttactgccaactccagtttggtaccgtttcttcttaaacaaagactatggaagcctcttttcatcactaatgacagggttgtacttaaccttcaagctgacatctgttgttgagaaggtacaatccttctttgctgcattgaaggcattatctcgtaaagaggtacattatggtgcttatgcaacatcagagcaggtgaatgctgctggggacctgtgtgccatctgccaagagaagatgcatgctcctatactactgcgttgtaaacacatcttttgtgaagattgtgtgtctgagtggtttgagagggaaagaacatgtcctttgtgcagggcgttggttaaacc

SEQ ID NO: 25326 - DNA, 388 bp, Gossypium hirsutum
  Clone ID: LIB3272-049-P1-K1-A8
atggtgaattcttccttacctggtactctcagatgctgttagaacacggggcgagaattctatcgtccgcaacatcgatttttgacggtgcaggtgtgaagatctctgtgaaagttgcgggaatccactggcattatggaacccgatcccatgctcctgaactcacagctgggtactataacacaaggtaccgagatggttacctcccgatcgctcaaatgctagcacgtcatggtgccgttttcaacttcacttgcatagagatgcgggatcatgagcagccccaagatgccttgtgtgcaccggagaagctagtgaagcaagttgctttagcaacaggagcagcacaagttccacttgccggggagaatgcacttccccgttatga

SEQ ID NO: 25327 - DNA, 387 bp, Gossypium hirsutum
  Clone ID: LIB3272-049-P1-K1-A9
cggacgcgtgggaaattccacattttcttcactgaaagcagcagctaaacaagggccgctctctttgcctcgcttatccataccctgtcagtgcctgcgtcagctcaaagcagagatgggagaaggaaagggctcaacccttgtgcaccttctggtggtagtccttagcttggtcgcatttgggtttgccattgcagccgagagaagaagaagcgttggcactgttgttaaagatgacataacaaattctacatattgtgtctacaactcggatgttgccactggctatggagtaggtgctttcttgtttcttctttctggtgaatcgctgttgatgggagttacgaagtgcatgtgttttgggaggccattagcaccgggtagtga

SEQ ID NO: 25328 - DNA, 285 bp, Gossypium hirsutum
  Clone ID: LIB3272-049-P1-K1-B1
cgaagacacatcgttcgagactctcctgatgttcctgatactcatcaactgcgtggatggatttacatcgttatcagaagtggaaacccaaagtgtatggggacacctaatacgagtggctagcaccaaaaccaacgtgtgggctttgcacgggggggggtgatactagaatgttgtttcactccaacgtaccagctgcaaagcactaatgatgctgaacgacaattgttggacaattctttttcccaaccaaccttgcctctctgtcttactcaagaccgattg

SEQ ID NO: 25329 - DNA, 371 bp, Gossypium hirsutum
  Clone ID: LIB3272-049-P1-K1-B10
caaaaagtgattagttgcagttcacacccccccctttaaaaataataataaccgtatcggtgataccgatggggactacttgctgaggggtcgaagaaacattctgcgactgagttgacctattttttggaattgaatcatttgcctggacggcggccacataaggaaggcgtatgataagctgaggttctgcagaatcaatatcctatgatctttatttcaaacctctgagaaagtgttggtgagtgggcgtttcaagtaaattcgaatcgacatggcattccctactaaaataaaagggatgaatccaatatttgagatggacggagatgaaatgactcggattatttggcaatctataaaagaaaagc

SEQ ID NO: 25330 - DNA, 386 bp, Gossypium hirsutum
  Clone ID: LIB3272-049-P1-K1-B11
tcaagttatttcccattttttggtctttctttatgccaactgataatcaaatgaaagacatgaaaccgaattccataatgggatcgtcagtcaccgacggcgagatcgtgtgcgtaacaggcggctctgggttcattggttcatggctcatcaagctgctcttggaacgcggttatgtcgtccgagccactgtgcgcgaccctggcaactcgaagaaggtgaagcatttactagagctacctaaagcagagacgcacttgactctttggaaagcagatttagctgaagagggaagctttgatgatgcaattcaagcttgtacgggtgtgttccatgtggccacgcctatggacttcgagtccgaggaccctgagaatgaagtcata

SEQ ID NO: 25331 - DNA, 386 bp, Gossypium hirsutum
  Clone ID: LIB3272-049-P1-K1-B12
aatcaatccaaccaaatcccaccatcaaaatccccgtaggggacccattcaacgatccgacggctagctttcactccgttaactttaactacaacaatgcagtcagtagtccttgccccgtcgattacctcgggtctctccaccgttacctaccgtcaaacgactacgagtccgattcgctgagtgatgattcggacttacctgttgatgcattctcatgcgaccatttccggatgtacgagttcaaggtgaggaggtgtgctcgtggaaggtcacatgactggactgagtgtccgtacgctcaccctggtgagaaggcccgaagaagggacccgagaaagttccattactctggaactgcttgccccgattttcgcaagggaagc

SEQ ID NO: 25332 - DNA, 388 bp, Gossypium hirsutum
  unsure (1)..(388): unsure at all n locations
  Clone ID: LIB3272-049-P1-K1-B2
tcgcactgtccattttttccaattattgttccttttttttattgtttttaattaagatggctgcaggcaaagtggtatggccagcgatttcttgctcttcttccggtctcgacggtggccagtcagtacctcttcccaaggccggcttcgtgaagttaccgttaccggcgccgttgacttctttggggttgagtagtggcaacaatgcgaggttgagctcggtgcaggcgactgaggaatccaccgtagtgattacggatgatcgcgttgctgttatttcaggtgaaaatctccgccagatggctacgaacattgtatggcacaaaagttcagttggtaaacttcatcgacaggagtngcttcagcaaaagggtngtgtcatatgggt

SEQ ID NO: 25333 - DNA, 391 bp, Gossypium hirsutum
  Clone ID: LIB3272-049-P1-K1-B3
tcttatttgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaagagctcaat

SEQ ID NO: 25334 - DNA, 384 bp, Gossypium hirsutum
  Clone ID: LIB3272-049-P1-K1-B4
cttcatttctactttcgccaccagtttttagggtttcttgatccttttctttgattctccgtttcgtcttcctacctcgacggatcaagattcctctctttgtttttggacaaaatcattaagtttgagctaaaccttcaagttattggctgaaacagcagccttaatttgaaacttgtaagttctgaatcagttggtgcttgacatacatggatcttgtagacgggcaagaagatacatgagtttgtttgataatgcagcttaatcatcttctcccatagttaatcttagcactgtccagtaataattcagtaatagcttgtggatataattctcagaaggctgcttgtacacattcagaggatcctttgtatccatgctggc

SEQ ID NO: 25335 - DNA, 385 bp, Gossypium hirsutum
  Clone ID: LIB3272-049-P1-K1-B6
ggcgacttaagccatgtcggaaaaacgggtcgtcctgctctgcggcgactatgccgaggactatgaggttatggtccctttccaggctctgttggcttatggtatatcagtggacgctgtttgtcccggcaagaaggccggcgaaacttgccgcaccgctattcatcaactttccggccatcagacctataccgagatccgtggtcacaatttcacactaaatgcatcatttgaagatatagaccatactaaatatgatggtttagttatagccggaggacgagctcctgaatatcttgctatggatgcatttgtattgaacatggttcgcaattttgttaattctggaaagcctgttgcttcaatttgtcatggtcaattgata

SEQ ID NO: 25336 - DNA, 197 bp, Gossypium hirsutum
  Clone ID: LIB3272-049-P1-K1-B7
ccggaaattactggccggcccaacccttccgtgcactatatatttttaagaataattgatggatttttttattgtttataaatgagatggctgcaaacactgatctaggtcagaacctttattttatagttccggtcattatggttggcagtaagaaaaccttccctaggaaaacttcatgaagttactttaaccgg

SEQ ID NO: 25337 - DNA, 329 bp, Gossypium hirsutum
  Clone ID: LIB3272-049-P1-K1-B8
ccttatctcaacctgagacaaaatcggttaactgacccttctgatccgagatcggtattggctgctaaaatcctctgaattttcatcaatggcgactaaaggtcaaggcataacttgcaaagtagcccgaggcttatgaaccgggcaggccactgaccattgtggatgatcaggtggctgcgacacaagccggggtggttcgactcaagactgtcttgactgatgtgtgacacgactgatgcctacactcgaagagcaaaggatcctgtgggcctattgccgagcgatgcttggacatagaagctgctgcaattgtagaaagtgcaaat

SEQ ID NO: 25338 - DNA, 388 bp, Gossypium hirsutum
  Clone ID: LIB3272-049-P1-K1-B9
ttccggttcgcctgtcattcaacgagagaaaaacaaaaaaacactcccgaaatggcacgcaagaagatcagagagtacgattccaagagattgttgaaagaacatttcaagaggctttccggtagagatttgccaatcaaatctgcacaaattacggaatcaactgatttcaatcagctagtagagaaggagccatggctttcgtcacagaaactggttgttaaacctgatatgttgttcggtaagcgtgggaagagtggtttggttggcttaaatctggattttgctcaagttattgctttcgtgaaagagcgccttggcaaagaggtggaaatgagtggatgcaagggacctgttacaactttcattgttgaacctttcatccctc

SEQ ID NO: 25339 - DNA, 385 bp, Gossypium hirsutum
  Clone ID: LIB3272-049-P1-K1-C10
attggtttcagttcagctgctccgtattatatagtcaactactatggcaaccagaatggctgttagatacgtttctcgtaggttctcgagtgggagtgggaagatactcagtgaggaagaaaaggctgctgaaaatatttacatccagaaaactgagcgagagaaattggagaaacttgcacgcaagggacccaagccagaggagaaaccggatgctggttcagggggtgctgcgaccgatggtagcactacctctacatcgggaacatctgctgagaaagtatcaaccgataagtaccgaaactacggggttctcgctggtgttgcaaccctcggtgctgctgtgggatggtatctcaactctaaagacatgaagcaagaggcc

SEQ ID NO: 25340 - DNA, 368 bp, Gossypium hirsutum
  Clone ID: LIB3272-049-P1-K1-C11
cttgaattctctcaagaaagccctaaatacctcggatcaggtctcagcttgtggttgttaagcctatttgatcaactaagtttcatgtctgatctcgacgtccagattcctactgcctttgatccctttgctgatgcaaatgctgaggactcaggtgctggtgcaaaggagtatgtgcacattcgtattcagcaacgcaacggtaggaaaagcttgacgactgtccaagggttgaagaaagaattcagctacaacaagatactcaaagacctcaagaaggagttttgctgcaatggtactgtcgtccaggaccctgaattagggcaggttattcaactgcaaggtgaccagcgcaagaatgtgtcaac

SEQ ID NO: 25341 - DNA, 383 bp, Gossypium hirsutum
  Clone ID: LIB3272-049-P1-K1-C12
gtgacttgcagactctttctgatgttgatctcaaactgattgccttgacttacacgttagagtctcaaattcatggaacaaatcatcttagggatgcgccgccccctgttcatgttgttaatgtgaagaggctgcctgaaagggacttgcctggatggggctctaatgtccctaatttggaagagtgggaagctctcgaaccggaaactggagatggattcaactctaactcgagaatccttcccttgaaagacttaaatatgaactatgtctcatcagataacaattctgaagatgtattggtggaaacaaagagtgaaacacattctgagaatcgagaagatattgaccagggttttaggaggcctaagcgctatttgccc

SEQ ID NO: 25342 - DNA, 367 bp, Gossypium hirsutum
  Clone ID: LIB3272-049-P1-K1-C2
aggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggctta

SEQ ID NO: 25343 - DNA, 373 bp, Gossypium hirsutum
  Clone ID: LIB3272-049-P1-K1-C3
gtgagatttatggttttatgtttacagtttactctctctttatatctgtttttatttaagagattattacggagattttttttctaaaaaaaccagtttactgctcttatacagttatacttatgaagttgagcagcaaaagagaaaaatggaaaaaggagggataattggagtggagaaaagaatgagaaaaggttaaaagctttgttggacttttttttcttttcatttatttgatttcgatttgagatatgaattatggattgctgagttttttttcaaaaagatctgtttttagctgatgggttttggccttgagtggttaaaagaaaggggaatggccggcagtcatgaagtcaacctcaatgagtgc

SEQ ID NO: 25344 - DNA, 387 bp, Gossypium hirsutum
  Clone ID: LIB3272-049-P1-K1-C5
aatcaatccaaccaaatcccaccatcaaaatccccgtaggggacccattcaacgatccgacggctagctttcactccgttaactttaactacaacaatgcagtcagtagtccttgccccgtcgattacctcgggtctctccaccgttacctaccgtcaaacgactacgagtccgattcgctgagtgatgattcggacttacctgttgatgcattctcatgcgaccatttccggatgtacgagttcaaggtgaggaggtgtgctcgtggaaggtcacatgactggactgagtgtccgtacgctcaccctggtgagaaggcccgaagaagggacccgagaaagttccattactctggaactgcttgccccgattttcgcaagggaagct

SEQ ID NO: 25345 - DNA, 387 bp, Gossypium hirsutum
  Clone ID: LIB3272-049-P1-K1-C6
cggatttggctgttgctgttccttaatctcaaatctcatctgcaccagccgacgacatggggaggagacctgcaaggtgttatcgccaaatcaagaataagccataccccaaatctcgatactgccgaggtgtcccagatcctaagatcagaatttatgacgttgggatgaagaaaaaaggtgttgatgagtttcctttctgtgtccatcttgtgagttgggagaaggagaacgtctcaagtgaggcattggaagctgcccgtattgcctgcaacatgtacatggccaagtttgcagggaaggatgctttccatttgagagtgcgggttcatcccttccatgttctgcgtatcaacaagatgctttcatgtgccggtgctgataggc

SEQ ID NO: 25346 - DNA, 139 bp, Gossypium hirsutum
  Clone ID: LIB3272-049-P1-K1-C7
aatcaatgccaaccaaatccctccatcaaaatcctctgttgtgaacctatggagaggattccgacggctacgcttttatctcctttaacttttaactacaacaagtgcagtcagtatgtcgcttgccctgtacgattac

SEQ ID NO: 25347 - DNA, 390 bp, Gossypium hirsutum
  Clone ID: LIB3272-049-P1-K1-C8
tttccctccaaatagggaaataccatcgctttgcatttgcaaagcctttcactgactcaaaaataacaatgacgtcctcttcatcgtccaccgccggcggttacgacgtgccttgggtagaaaaatacaggccgagcaaagtctcggacatcgtcggcaacgaagatgccgtgtctcgactccaagtcattgctcgcgatggcaacatgcccaatctcatcttatccggtcctcctggaactggtaaaacaactagtattttggctcttgcacatgagcttttggggccagtctataaggaggctgttttggagcttaatgcatcagatgacaggggtatagatgtcgttcggaacaagattaagatgtttgctcaaaagaaagtaactt

SEQ ID NO: 25348 - DNA, 387 bp, Gossypium hirsutum
  Clone ID: LIB3272-049-P1-K1-C9
gccttttcttctttcttctctgtccttccattttcaaaaacatgactgtcttgttctttttctattcttcatcttatagctttgtgggtaccccttaaaaggaatatcaattttgacttcatttcctagttttttttcctctagttattcagctttcttgggtaccctttactctcattctagttttttttttcgtaaattttcctgttattattccgtttggtggaggtagttggtaattcggttgaacttgcactgtggagaagaaaaaataaagtaaaacttggggggtgttcatggaaattgatctgaaccatgcagtaaacgaggtggagaagactgtactttgcaatgggagctgtgaaaaagctagtgcttgcgtttact

SEQ ID NO: 25349 - DNA, 381 bp, Gossypium hirsutum
  Clone ID: LIB3272-049-P1-K1-D1
aaatggttgaaactggtgaactaccttatgaggagataaaatctagaggtttgggtaaaaagagagtgtagggtattgcgattggaagagaaaaaatggggatgggtctcgggcacgttatatggacacagtgagtagctcctcctgcagcatagattacaacatgatgctgctgttattacggcgaataatattgctgctaggtcttgattcattataagcatgactcttatcgatgctggacgaaaaccaacttttcctacgtgggtgttgaacatacatgccggtaatgagattgtgttgagggtttcatttgtgtatgcaaggttgataaacttgtgttgctcaaagaggattgattggtcggagttggaggcacat

SEQ ID NO: 25350 - DNA, 383 bp, Gossypium hirsutum
  Clone ID: LIB3272-049-P1-K1-D10
gaaagcttgaattctgaaatcgtttcaagccatgagcacgactcaacaaggaacccactcccttgccttcagggtgatgcggctttgcaagccttctttccacgtcgaacctcccttccgccttgaccccgccgatctcttcgtcggtgaagacatctttgacgacccactcgctgccgctaaccttcctccgctcttatcttcccaactcactaagtcaatggactcctccgatctgacttacggcaaccgattcctcctccaccatccatctgatgctatgggcttctctggcctcctcctcctccctcaatccttcggggcgatttatttgggagagacattctgcagctatattagcatcaataataactctaattttg

SEQ ID NO: 25351 - DNA, 382 bp, Gossypium hirsutum
  Clone ID: LIB3272-049-P1-K1-D11
ttcaaaaggagctacaagaatgtagcagagaaaaagactcttcgggcattagcgtctctccaaaatcagacaatcttgctcgcttgactggcatcatccctggtccccttggcactccctatgaagggggctcctttgaaatcgatatcacattgcctgatgggtatccatttgagcctcccaaaatgaagtttgtgacgaaagtttggcacccaaacatcagcagccaaagtggggcgatatgcctggatatattgaaggaccagtggagtcctgcactcactcttaagacagctcttctttctgttcaagctttgctttcagctcctgaacctgatgatcctcaagatgctgtagtagcacaacagtatcttagagagta

SEQ ID NO: 25352 - DNA, 387 bp, Gossypium hirsutum
  Clone ID: LIB3272-049-P1-K1-D12
gagaaactagtgcaaaaagattttactctattgcgctagatgtttaagtgcataaagtaaactcatgctcgggtaatcgactcttaggtctatgtcgaacatatggtagtcaaaaacactataacatctcatataagaagcgcgtggctaggttaatgagaaccacaccgtctctgttaactatgaatataaaccacagtcttcttaacctgtctaatataatcaatctggatagtatacccggccatactggaatcgatctcgtctttagtacgcgtcttgcgaggaagaggactgacgagagctctaagtcgatattgagaccccactagtacaacgtcatgttacttattcacgcacttaacatgcgaggcacactcaccattt

SEQ ID NO: 25353 - DNA, 393 bp, Gossypium hirsutum
  Clone ID: LIB3272-049-P1-K1-D2
ttttcttctcttgtgacactgctaatattttttttattgtcgtctccggcgttcgaagatcataaaaaaccggagtcgtttcaaatggctacgagaacggatctagatgggaggccaataaagccgatgacgatatgcatgatcggtgccggaggcttcatcggctcccacctttgcgagaaattgatgtcggagacgccgcacaaggtgctcgccttggacgtttacaatgacaagatcaagcacctcctcgagcctgactctctcccttgggctggccgtattcagttccaccgacttaacatcaagcacgattctaggctcgaaggcctcatcaagatggcagatctcgtgataaatcttgctgccatctgtactccggcagattataat

SEQ ID NO: 25354 - DNA, 392 bp, Gossypium hirsutum
  Clone ID: LIB3272-049-P1-K1-D3
ggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctgaccctg

SEQ ID NO: 25355 - DNA, 388 bp, Gossypium hirsutum
  Clone ID: LIB3272-049-P1-K1-D4
gaagaccattaaacttcaaatttgggacactgctggtcaagaaagatttaggacaattactagcagctactaccgtggggctcatggcataataattgtttatgatgtgacagaccaagaaagcttcaataacgttaggcaatggctgagtgaaattgatcgctatgctagtgataatgttaacaaaatactggttggaaacaagtgtgatcttacagcgaataaagttgtgtcatacgaaacaggcaaggcacttgcagatgaagttggcataccttttatggaaactagtgcaaaagattcaactaatgtggaacaggctttcatggccatggctgcttccatcaaggacagaatggcaagccaaccagccatgaacaatgcaaag

SEQ ID NO: 25356 - DNA, 388 bp, Gossypium hirsutum
  Clone ID: LIB3272-049-P1-K1-D5
cgaagtggtcgaaatgaaatgggatatggagatcgaggaaatcgaagcagttctcgagaaaatctgggacttacacgacaagctcagcgacgccattcactccatttcgcgagctcacttccttaactccatcaaagccctaaaaaaatccgacaagaagaagctctacgacgatgtcgtagtcggcgcggacgataacaggactggcttcgtgttcgtcaaggaatttagaatcgacgatggtgactccgcaattcaagaggccaagagtcttaatgatataagaactgctctcgagaatctcgaggaccagctcgaatttttccacacagtacaaatacagcagcgtgttgagagagatgctgccattgcacgattagaacaaagc

SEQ ID NO: 25357 - DNA, 386 bp, Gossypium hirsutum
  Clone ID: LIB3272-049-P1-K1-D6
cggacgcgtggggaagacagagaggtctcctcacaaccaccgtaatgggtcgtgtcattcgagctcaacgtaagggtgccggttcggtcttcaaggcccatacccaccaccggaagggtcccgcccgtttccgcagcctcgacttcggtgaacggaacggttaccttaaaggtgtcgtcaccgacgtcattcacgaccctggacgtggggctccgttagcccgcgtcgttttccgccaccctttccgttacaagaaacagaaggaattgttcgtcgccgccgagggtatgttcaccggacagttcgtgtattgcggtaagaaagctacccttgtggttggaaatgtgttgccccttagatctatccctgaaggagctgtcgtttgc

SEQ ID NO: 25358 - DNA, 378 bp, Gossypium hirsutum
  Clone ID: LIB3272-049-P1-K1-D7
gggaaaacaaagattaccttttttttttttttgggggtttgagaatggcgtttgctgttacttcatcgtcttcttcaactgcgatttctggttctagctttcctcgttcaagtgcctcccctgatcccaaagttccacaaattggttcagtccggtttgcagatcgtcatgcaacggtgaatctgtctcgaagacgttgcgcagtgaagcccgtaaatgcggagccaaagcgtaatgattccatcgttcctttagcagcaaccatcgctgctccagaaatatcggaaaaaatagaggcggaggatttcgagcaattggctaaagaacttgacaacgcttcttcacttgaaattatggataaggctttagagaaatttg

SEQ ID NO: 25359 - DNA, 386 bp, Gossypium hirsutum
  Clone ID: LIB3272-049-P1-K1-D8
cggacgcgtgggttgggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgctccactgctgctggactccacaagaaggagcttgtctgagaaggagacagacaggagctttggcctaaggaatttcaggtacattgagaccatcaaagaagctgtagaaagg

SEQ ID NO: 25360 - DNA, 387 bp, Gossypium hirsutum
  Clone ID: LIB3272-049-P1-K1-D9
atatccgcctgtctcatcttccgttgtttatacgtttggttgttgttgaagaagtgctactaccatggctacaaagaagagcgttggggacttgaaggaagctgatttgaagggaaagaaagtgtttgttagagtcgatctgaacgttccattggatgataacttcaacataactgatgacacaaggatccgtgccgctgttcccaccatcaagtatttgatgggtcatggctctaaagtcatcctctctagtcatttgggacgcccaaagggtgtcactcccaagtacagtttgaagcctcttgtgccaaggttatctgaactccttggagtcgaggttaaaatggcaaatgactgtattggtgaagaagttgagaaaatggtggc

SEQ ID NO: 25361 - DNA, 392 bp, Gossypium hirsutum
  Clone ID: LIB3272-049-P1-K1-E1
aatcaatggaggggaaagaagaagatgttagattgggagccaacaagttcccagagaggcaacctattgggacagcagctcagtcccaagatgataaggattacactgagccaccaccagcacccttgtttgagcctagtgagttgacctcatggtctttttaccgagccggaatcgctgagttcgttgctactttccttttcttgtatatctcggtattgactgtgatgggagttgttaaggacaaaaccaagtgtacaactgttgggattcaagggattgcttgggcttttggtggtatgatctttgcacttgtttactgcactgctggtatctcaggtggtcatatcaatccagcggtgacatttgggctgttcttgggtaggaaattg

SEQ ID NO: 25362 - DNA, 380 bp, Gossypium hirsutum
  Clone ID: LIB3272-049-P1-K1-E10
gaaaatctggaatagtaagaaactagattacaagcttgagaaagagtttttagctgaagttgaaatactgggcagcattcgccattccaacatagtgaagttgttgtgttgcatttccagtgaagattcaaagcttctggtatacgagtacatggaaaatcagagccttgataaatggcttcatgggaataagagatcaccaatgtcaaggatgggttcagttttggattggccaacaaggttgcaaattgctgttggagctgctcaggggctatgctacatgcaccatgagtgtccaacaccaatcattcatcgtgatgtgaagtcgagcaatatcttattagactccgaattcaaggcaaaaattgcagattttggac

SEQ ID NO: 25363 - DNA, 385 bp, Gossypium hirsutum
  Clone ID: LIB3272-049-P1-K1-E11
atttatttgagtttgaatcccctctcgttaatcaaattagggtttcttgaagccaaatcgaccagacatgggaggaggcaatgcccaaaaatccaagatggctcgtgaaaagaatctcgagaaggctaaaaacgcagctaaaggcagccagctggaaacaaacaagaaagctatgacgattcagtgcaaggtatgtatgcaaacgtttatatgcacaacatcagaggtaaagtgcagggaacacgcagaagcaaagcatccgaaatccgatgtgtatgcttgcttccctcatctcaagaagtgatgtatttgaagcaagaaaatgccatatatatattatagaattgtttggaatatcttttcccttatcatgtaaaacctcagc

SEQ ID NO: 25364 - DNA, 383 bp, Gossypium hirsutum
  Clone ID: LIB3272-049-P1-K1-E12
cttaaaagaacgctgtaccatcaaaaccagctagctaaatcaaccgcattccaccaggatggctagaggattgaagaaacacttgaagaggctcaatgcccctaggcattggatgcttgacaagcttggtggtgcttttgcacccaaaccatcatctggaccccacaaatgcagggaatgcttgccattaattctcattctgcgaaacagatcgaagtatgctctcacgtacagagaagttattgctattctcatgcacaggcatgtcatggttgatgggaaggctcggaccgataagacttatcctgctggtttcatggatgttgtgtccattcctaaaacaaatgatgacttgcgtgtcctttatgacaccaaagggcgtt

SEQ ID NO: 25365 - DNA, 368 bp, Gossypium hirsutum
  Clone ID: LIB3272-049-P1-K1-E2
gaaaaaccctagaaccgggatcgagatggctgtgtagatgcatgtcggcggaataacgttggatctgaattggttcctgcaattcattttcacgctcttcattgtcgcattggcgtctcttcgcttgctgaagaacacggcgtcgaactacttggaggtctacgccaatttttgtcgggaccaaccaatgccttgcatgccgatggacgccgatcacttgccttgcgccgtatgctctaatcccgccttcaagaagtgctctcggtgcatatccggtcgttattgctcctcatcctgccaacaggtggactggaaggatgggcataagacaaagtgcataggcttatcaacacatactacaaccacca

SEQ ID NO: 25366 - DNA, 386 bp, Gossypium hirsutum
  Clone ID: LIB3272-049-P1-K1-E4
ctcttttactcattcattctttagtttcaatatcaaagcaaaaatggcttcttcttgtaatgttgtttcaatggctttactggcttgtttggtgttgaactccttggtttttgttgcccatggtggtgacttttaccaggatttcgacctaacatggggtgacaaaagaggcaagattttcaatggtggcaagctcttgtctttgtctttagacagggtttcagggtctggttttaaatccaagaaagagtatttgtttggaaggattgatatgcaactcaagcttgttgctggcaactcagctggcactgtcactgcttattatctgtcatctcaagggccaacccatgatgagatagactttgaattcttagggaatctgagtg

SEQ ID NO: 25367 - DNA, 388 bp, Gossypium hirsutum
  Clone ID: LIB3272-049-P1-K1-E5
agattatcaatttgaagccttcttcgaatttcctcattcaagatgcaaattttcgtcaagaccctcaccggaaagaccatcacattggaggtggagagttctgatactattgacaatgtaaaggccaagattcaggacaaggaaggcatccccccagaccagcaaaggttgatcttcgctggtaagcaacttgaggatggccgcacgttggctgattacaacatccagaaggagtccacactccacttagtgcttcgcctccgtggaggaatgcaaatttttgttaagactttgactgggaagaccattacattggaggtagagagttcagataccattgataatgttaaggcaaaaattcaggacaaggagggaattcccccagacc

SEQ ID NO: 25368 - DNA, 390 bp, Gossypium hirsutum
  Clone ID: LIB3272-049-P1-K1-E6
agaaaatggcgaaagctccaaggttgaagatagcggcaataaacttgctatggtgggcggagctgctggggggcaggctggatgcgacacaccacgaggtggtgcacgccgaatccgatttggaaatacagacactaccgggacgccacgtggatgtctgcaaccgttaacgacctttccttacaaaaagccaccttatttgggttccacagattattccagtttatacaaggtgcgaatatgaattattctcggggagccatgacatcattcggtggtgacttgcctagttccgggtgctgggccacttcacttatcatcctatgttgtccgattctacttgcctgccaaggtccaggacagtccaccaaccccacttacggagctaaa

SEQ ID NO: 25369 - DNA, 393 bp, Gossypium hirsutum
  Clone ID: LIB3272-049-P1-K1-E7
cagacagtttgcttaaagcttcacgcatctcgtctctcatggcggcctcgttgctcttatctttaacagcgccaaacccagaagcgatggttcccaatatcggggccaataaatcgtctttcctctccggcaccaagctcttcttgttgacgaagccccattctcgaaagcccactgctcaaaaatgcttcaaacctccctttgccaagtcaatcgaccacatccccaagcaattcagagaacaaaatctcaaagatggattgatggaaaattataaaaatgttcctggatatctttatggtcttagtccttcacaaatggacatgttcatgacagaagataatcccgtccgtcgacaatccgaaagtgttaccgaggaaagtatttcatctg

SEQ ID NO: 25370 - DNA, 390 bp, Gossypium hirsutum
  Clone ID: LIB3272-049-P1-K1-E8
gaagtagtttgggttttcgttttttgagtcaaactatcagtttacttcctctatcatcgcaaattctgaaagaagagggatccgatctgatctgctgcaaatgggggagaaatgggtgttgatgaaaacggctcagacgcctaccaacattgcagtgattaagtattgggggaagagggatgagacccttattttgcccgtcaatgatagcatcagcgttactcttgatcctgctcatctctgcaccacaaccaccgtcgctgttagccctgctttccaacaagatcgtatgtggctcaatggcaaggaaatatccctttccggaggaaggtaccagaactgtttgagggaaatcagaaaacgggctagggaagttgaggataaagagag

SEQ ID NO: 25371 - DNA, 51 bp, Gossypium hirsutum
  Clone ID: LIB3272-049-P1-K1-E9
gtagtacgagcactgttccatgtgacagcatcttgctctagctgtcactac

SEQ ID NO: 25372 - DNA, 392 bp, Gossypium hirsutum
  Clone ID: LIB3272-049-P1-K1-F1
atttctttctcctaaaattctattttattttttactctttttgttttatgttactctaatctaatgccatggagagtagtaaccggagacttacgcttttcgagcagatgtcagcggtcgacaacggccgcaccactctggccgctgctttcactctcgatgcccttttgggaaacactaaaccgcctcaacaaccgtcgtctcacaaccgtacgcttctggagattatattagacgatgggtccaacaaagacaagaagagttggaaggcgtttcgggacaagatccggctcaagcgaccgggctctgccttgaccttctcggttcatgttccggtttccgatgtcaatgttcagactgatagatctgagtcaccgaggagcggtccgttt

SEQ ID NO: 25373 - DNA, 384 bp, Gossypium hirsutum
  Clone ID: LIB3272-049-P1-K1-F11
cggacgcgtgggaacctatcctctccctttcaaggttcccagcagccaaacatggcccacgccggcgagcggcggttccaaaggccaaagctccttcacgagcggtggtcggagcgagaaaaggagggctttttaaccccgttctcgacctccaccttaaggcccggtcctccagaccaaacaagccgaaacaaggagagacctttcgtctccttctcggtccgattccaacaccgaagatggtctccggcgacgggctttcgagaccggtactggtgaagtcaacgggtattggaagaataaacctagcctttttggtgcaaaactggtcgtgcttcgggcgttgagtgcgctgcaaatgcacgaggagacgtacggcgcact

SEQ ID NO: 25374 - DNA, 60 bp, Gossypium hirsutum
  Clone ID: LIB3272-049-P1-K1-F12
gcgttttaatatataaataaacaagtctaggcctaagtcacttactccgggggcgggcac

SEQ ID NO: 25375 - DNA, 396 bp, Gossypium hirsutum
  Clone ID: LIB3272-049-P1-K1-F2
ctcttccaaaaaattttccccagggagtgaaaaggaacaaaaaatcttctactcaagaaaagagagaaagatcttccttagcgaaactatttgcaggaaaatcaaaaagaacagtgatgagttattacaatcaacaacagcctccagttggtgttcctcctactcaaggttatccaccggaaggatatccgaaggatgcttatccaccaccgggatatcctccacaaggatatcctcaaggttatcctcctcaaggatatcctcctccttacgcccctcaatatcctgctcagcctcctcctcagcaacagcaaagtactggtttcttagaaggctgtttggctgctctgtgctgttgttgcctgctggatgcttgcttttgagaatccaactatg

SEQ ID NO: 25376 - DNA, 355 bp, Gossypium hirsutum
  Clone ID: LIB3272-049-P1-K1-F3
accccttccgtcatacaaaaaactgtccccagggagtgaaaaggaacacaaaatcttctactcaaggaaagagcgaaagatcttacctagcgaaactatcagcacgaaaactaaaaagaacagtgacgagcaagcacaacgcacagcggagttcatttagtgcatgcactacctaaggctatgcacaaccagaatctccgaatgaagcttatacacaaggaacatattctccacaaggatataaaacaggatatgctccttacggacatcgtggagaatacgcccttcaatataccgctaagactactgctgaacaaccgaaaaacactgtgtgctgagaaaggagtacagatgc

SEQ ID NO: 25377 - DNA, 277 bp, Gossypium hirsutum
  Clone ID: LIB3272-049-P1-K1-F4
aagatagggaaacgaacgtgttatgctagagaccatctgacacgttccatgggatgataactccaacatatcttttgacactaggatctgttcctctgacccaacaagaccgaatcctagggttcatgcttttaaaaaacccaatctcctagaccttcggctcccgctaaagctgcacttcctagcctcagtttgtatgcccttatgacaacgatatttgaacgcgttgaagtgttggatgaaatggaacatgtctgtctccaactcaaaagcgaca

SEQ ID NO: 25378 - DNA, 383 bp, Gossypium hirsutum
  Clone ID: LIB3272-049-P1-K1-F5
gttaaacccaatggcgatcccaactcagttagtcctctcctttctcctcctttctttttcccctgtcgttttttcagaccgtgaagattgcgtttactcggtctacataaggacgggatccatcatcaaaggcggaaccgactccatcatcggcctacggctctacgatgccaatggctactcagtggagatcagcaacatcgaagcatggggtgggttaatggggccaggatacaactatttcgagaggggtaatttggacattttctcaggtaggggacgttgcttggatgcccctctttgtgccatgaacttgacctccgatggttcgggtgagcaccatggatggtactgtaactatgtggaagttaccatgactggcg

SEQ ID NO: 25379 - DNA, 388 bp, Gossypium hirsutum
  Clone ID: LIB3272-049-P1-K1-F6
gtgtgttagaaagaaaaaaaaaaaacgaagggttcaaatctctttgtctgtggggtttccagaccagttcttgttggcgaatttgatcttaaaagtgcctcatttctgcttctaatggccgtaatgaagtccacatggagatccattatgccaaggtgttcaacgggtcttgaagaaccacccgcagacgccgaggccgaaccagcgacaaagtaacaagattcaaaacatggttctttttccaggcttgcaatgatagatttaagttacccaagttcgaggttcaccgaggatctttccacatggcttgccagttcaaatctatatgtttttacactggcggaattaaaggcgataacacagtgcttctcatcggctaattttctag

SEQ ID NO: 25380 - DNA, 388 bp, Gossypium hirsutum
  Clone ID: LIB3272-049-P1-K1-F7
aaagagttaaacccctaaaaacactttcttcttccatctctcttctcccttaaacaacaagcttaaccctagcaacaatggcatccatgctgcaaccccaaatcattcttttgaaagaagggacggacacatcacaggggaaggcgcagctcgtcagcaacataaacgcttgcaccgcagtggctgatgtggttagaacgaccctgggtcccaggggcatggacaagctcatccacgatgacaaaggaaatgtcaccatttccaacgatggcgccaccatcatgaagctcctcgatattgtccatcctgccgccaagatccttgttgatatcgccaagtctcaggactcagaggttggtgatggtactacaactgttgtactgctagc

SEQ ID NO: 25381 - DNA, 388 bp, Gossypium hirsutum
  Clone ID: LIB3272-049-P1-K1-F8
caaaaatcttgttcaaaaagaaaccctaaatcatgggtcagggaacaccgggtggtctgaaccgacaaggctttccaggggatcggaaacaggatggtgccgataagaaggagaagaaatttgagccggcggcaccaccggctagggtgggccgtaagcaacgaaaacaaaaaggaccggaagcggcggcccggcttcctactgtgacgccgcatactaagtgtaagctccggctgttgaagctggagcgggtcaaggactatttactaatggaagaagaattcgttgctaatcaggaacggctcaagccgcaggaagagaaagccgaggaagatcgatctaaagtcgatgatttgagagggtcgccaatgagtgtgggtaatttgga

SEQ ID NO: 25382 - DNA, 383 bp, Gossypium hirsutum
  Clone ID: LIB3272-049-P1-K1-F9
cttcaaagaacgctttaccatcaaaaccagctagctaaatcaaccgcatttcaccaggatggctagaggattgaagaaacacttgaagaggctcaatgcccctaggcattggatgcttgacaagcttggtggtgcttttgcacccaagccatcatctggaccccacaaatccagggaatgcttgccattaattctcattctgcgaaacagattgaagtatgctctcacgtacagagaagttattgctattctcatgcagaggcatgtcatggttgatgggaaggttcggaccgataagacttatcctgctggtttcatggatgttgtgtccattcctaaaacaaatgaggacttccgtctcctttatgacaccaaagggcgtt

SEQ ID NO: 25383 - DNA, 388 bp, Gossypium hirsutum
  Clone ID: LIB3272-049-P1-K1-G1
cttcacatctttttggcaatcaattttgtaagcaagtatggctaaggacgttgaggttggtggtgagttccaagccaaggactaccatgatcctccaccagctccattggtggacggggaggagttgacaaagtggtcattttatagggctgtaatagccgagtttattgccacgctcttatttttatacatcactgtgttgacagtgatcggatacaagagtcaggttgaccctgataagggcagtgacgaatgtggtggtgttggcattcttggcattgcttgggcttttggtgggatgatctttatccttgtttactgcactgctggtatctctggaggacacatcaacccagcagtgacctttgggcttttcttggctaggaag

SEQ ID NO: 25384 - DNA, 351 bp, Gossypium hirsutum
  Clone ID: LIB3272-049-P1-K1-G10
gccgacccagtcgttcgggaagaccgaaaaaaaaaaaatgacgggcccaaaactctttgactgtggggtttgcaaaccagtacttgcgggcgaattaagatcttaaaagtgcctcaggtttttaattaaaggccctgattaccctataatggaaatctacaaatcaaaggtgaataaagtagatggacgaacgacacgctgacgtaaagtccaaacctgagcctaagattcaagattcaaaacacggttctttttccaggctagcaatgtacaatatacgctggtgctgttgccaaggaatacattaacattcgtattcagctgcgagacgaaatgaaaagcctgaccact

SEQ ID NO: 25385 - DNA, 237 bp, Gossypium hirsutum
  Clone ID: LIB3272-049-P1-K1-G2
gtagcaacaacatcgaaaacactcttgatgtcttggctactcgacacctggggggctgtagttgcattgggagcagcagtggaaacccaagggtttgggggatgcctcatgtcggtcgcaagtgtaaaaggttgcgtagaggcaatccacgaggttgtttagcacgagaagttcgatgcactccaacctaaatgctggaaagcaatcatcaagctgggcgacaattgttggccaatt

SEQ ID NO: 25386 - DNA, 386 bp, Gossypium hirsutum
  Clone ID: LIB3272-049-P1-K1-G3
ttctagtctcttcctagctaaaaccagcccaaaatcccatagaccggccaccggaaccgccgtctaccgctgttctccgccttggggcgcccctagcagaaatctttatcccaatccatctaggggatcccgtttccttctcttttcacattacctagataaattttccccaaacaaaaaccctaagaagccctcgatctagattgaaaatttggtactgccacctcctcaagtctacgtttccttttggaaatcatctcctagctgctaaaccttcttggcttttctggtttgggattttttattacgggattttctttgatcgaggttgggattgaaaattgctggctgaagtataattattttttgttgttgatggaaattgc

SEQ ID NO: 25387 - DNA, 379 bp, Gossypium hirsutum
  Clone ID: LIB3272-049-P1-K1-G4
gtgtgttagaaagaaataaaaacaacgcagggcccaaatctctttgactgagggcggctaacaccacttccggagggcgaattagatcttaaaagtgcctcatttctgcttctaatggccgtaatgaagttcacatggagatccattatcccaaggctttcaaagggtattcaataaccacaaccagacgccgttcccgaaccagcgtctcagatgcacgattcaacccctggttctatttccatgcttgcaatgatagatttaagttacccaagttcgaggttcaccgaggatcttgccacatcgcttgccagttcaaatctatatgtttttacactgtgcgaattaaaggcgataacacagtgcttctcatcggcta

SEQ ID NO: 25388 - DNA, 389 bp, Gossypium hirsutum
  Clone ID: LIB3272-049-P1-K1-G7
cttggagttcctgtacgaccagtcgccggaaagcatgcgaagcacggcggcagccctgtattggacagccatttccatggggaattacattgggacattgctggtttcgcttgttcataaatacacaggtgaaaacagtaactggttgccagataggaatctgaacaggggaaaacttgaatattattattggcttgttagtgggatccaagtcctgaatctcatttattacataatttgtgcttatctttatacttacaaaccattagaagaggttacagaggaagaagaagaagatggtgaattcaatggaaagaagatttcagaaaaaggagttgagcttactgtaaacgaaacagcttagttggctttgctattaagggaattat

SEQ ID NO: 25389 - DNA, 392 bp, Gossypium hirsutum
  Clone ID: LIB3272-049-P1-K1-G8
caactaatggcggttgtcacaacattcggtgcactgcagacatcaacggacaatgcccgaatgagttaagagctcctggtgggtgcaataacccatgcacggtgtttaagaccaatgaatattgttgcactcaagggtacgggacctgtggtccgacccgttattcaaggtttttcaaggaccggtgccgtgattcatacagttatcctcaagatgatccttcgagcacctttacttgccctgctggttccaattacagggtcgtgttttgcccccgaggctcacctcatatagagatggtcggaagtaagagccaagaaaaataaagggatcatctcttggtctagttaatctgcgccttggaactaaaaaataaaaaagtcatttggtct

SEQ ID NO: 25390 - DNA, 390 bp, Gossypium hirsutum
  Clone ID: LIB3272-049-P1-K1-G9
cggacgcgtgggtttttttgtatttttcaacttccttggtgttaaaatcagtttgattttctctccttttttccagattacattgcatttgactcctttcttcctatcaactgcctgaccaagtgacagattttttcattcattaaaaagaatgttaggtttaaagaaatctccattgaagactgctaagcataattcagttgatcctgcgcgtgtggccgcttctcgttccaacccctttgattctgatgacgagtttgacaataagcaaacccttaaaccttcaagaaggacttcttctgaacctactttgagtccaccgaattttggggccaatcctcttgatgacaatgaggggaaagtgaactcttcttcttcatattggcaaag

SEQ ID NO: 25391 - DNA, 230 bp, Gossypium hirsutum
  Clone ID: LIB3272-049-P1-K1-H1
ggcatttttgaaggggtcttaacaaaaacaatcggggtaccaatgatttgcaactacttatatattgggacctgtataaatttttagtggggacaagactgagagtgcatgttgattgaaatcaaagaaagggatgggacaaaagagaaggcgctgagaaaagtgtactgaacgtgacaaatgaatgaaacggatgagtatgatccaagacgcatgtctgataagaggag

SEQ ID NO: 25392 - DNA, 392 bp, Gossypium hirsutum
  Clone ID: LIB3272-049-P1-K1-H10
gtttctctccatctagccgtatcgcgtgcgccctgtggctctcttcaaccctcgcatatctcttcaagatctgatctgatctgacaaaaaaatgttcgggagagcaccaaagaaaagcgattatactaaatactatgagatattgggagtgcccaaaaccgcttcccaagatgatttgaagaaggcttatagaaaagctgcaattaagaatcatcctgataaaggcggtgatcctgaaaagtctaaagagttggctcaagcttatgaggtgctgagtgacccagagaagcgtgagatatatgatcagtatggcgaggacgcccttaaagaaagaatgggtggatgcggtggtgcccatgatccatatgatatcttccaatccttctttggtg

SEQ ID NO: 25393 - DNA, 270 bp, Gossypium hirsutum
  unsure (1)..(270): unsure at all n locations
  Clone ID: LIB3272-049-P1-K1-H11
acccacgcgtncgctcttttgaattgtccctcacgcgagcagcttctatctacgaccaccgggcgtttccttttgagatggtgtggcctttaaataaaatatgggggcaattgtccataccgaacctgttttttctaaaccctttggggtttttggggggcccaaagcctttttccaagatgtgcttgggcaggttttttttaaggctttccaccggctttcctttcctttatccaccgtcaacgccgggtccagttctcgcagggcatt

SEQ ID NO: 25394 - DNA, 390 bp, Gossypium hirsutum
  Clone ID: LIB3272-049-P1-K1-H2
caagccactaaggttttgagagaagatcaaaatggcttctaaaagatcagcttccatggtcctccttttggcactcaacattctctttttttccctagtcagtgcttgtggctcttgctcttcacccacccctaaaccaaggccaaacccaaaccccaacacccccactcctactccatctgcacgaggcaggtgccctagggatgccctcaaattaggtgtatgtgccaatgtgcttaacctagtcaatgtcaccgttggttcacccccagtgatgccatgctgttcccttctcaatggccttgtcgacctcgaagctgctgcatgcctttgcaccgctatcagagcaaacattttaggcatcaacctcaacatcccaatttcccttag

SEQ ID NO: 25395 - DNA, 380 bp, Gossypium hirsutum
  Clone ID: LIB3272-049-P1-K1-H3
cttcgaagtcgtagctttggaagcatggacttcatagctactatcctgtttctagctcttgtcatctcctccaccaaagctttggacccttgcggccctcagccagatgactcggaccttttggtcatcccaatctatggcaaatgttcaccattcaacccacccaaacctgactcatcgttcaacacagtcatgaacatggcatcaaaagacccagcaagggtcaagtacttgtcgagccttgtagcccaaaagaccactgcggttcccattgcttcaggccaacaagtcctaaacattggcaactatatcgtccgggtaaagattggcactccgggtcagctcatgttcatggtattggacactagcaatgatgtggc

SEQ ID NO: 25396 - DNA, 386 bp, Gossypium hirsutum
  Clone ID: LIB3272-049-P1-K1-H5
ccctatatcaattatccctaaccaaaaaatattcaaacgacgaccaccggccaccgacggcgaagaggaaagagccgtttaaataaaatatggacacaacggtccataccgaacctgtatctatcactcgcttacgcgccacttagaattgcaccgctttcattcaccatatgcctggccagctaatattgcgtgctttccaccgactttgctttactttatccaccgacaacgccggattcagttctcgcaggtcatgcacttttgttgtcgtcgcttgcgacactatgaccgccaattccgtctcgccaagaggtggagtatatacaggtggggatttcatgacgagaaaagaggatttgcatgttgtaaagccaacatcatct

SEQ ID NO: 25397 - DNA, 389 bp, Gossypium hirsutum
  Clone ID: LIB3272-049-P1-K1-H7
gtcaaccactaactcccagcgatctggagagaaagaagagatgaaagtgaagtcgtggttagttgcatcggcgccatttgcagccatggtggctgtggagtgcctggatgttggcttaaccaccctcagcaaagctgccatgtccaaaggaatgagccactttgtccttgtcgtctactcaaatgctctagcttccctcattcttcttccggcggcttttttcttcacaaggaaaaagcggccaccaattactttatcttttctgtgcaaaattttctgcttaagcattgctgggatcactttgatgcagaactgtgtaatcaccggtgtaagttacagctctccaacccttgcttctgctcttgccaacttaatcccagctttcactt

SEQ ID NO: 25398 - DNA, 383 bp, Gossypium hirsutum
  Clone ID: LIB3272-049-P1-K1-H9
aaagaccccatccactctatgcttaactcgtcaacggtggccaataacctcgtgtactagctatgtacgtagactccgactctatatatgtgtctttcacagagggtgagggagtgagaaaacaaggagcatgcatcaaatggagcaacaaccattcaactacgcctgacagggaccaggcaccgtgttattaggccactctacggtatgcaccgtaccctgtaccggcttagaggggcagtgtctagagaaactttcctatggaaacaacatgtggactgacaactgacaagggcataccccaaactatgtcgcagatcacgacaccacttattgcggaggagctatcgaatccaaaggcagacaggctcatatggcattac

SEQ ID NO: 25399 - DNA, 394 bp, Gossypium hirsutum
  Clone ID: LIB3272-050-P1-K1-A1
ccttggtctactacacgtctacggagagctacacactacgctacccttatcgttccctcgccattgccaagaacccagaagaacaggcctccaaaattggctgaaacaagttctcccatcttggttgttctgacagacaggctagttaaagataagaatggcgcacacctgcatttcgacatcggcatcgtctcttcggttgactagcctgcccttctcttcaaaatcaagcaccaatctttactctcataacttatctcttcctttccatccccttcctcccaggaaactgaagaagctatttagtaatcaaaagaatgcgaggggttctcagccaaaggctgtctacacaggtgagttttgggctccagagaaaagctctcgacatggaatt

SEQ ID NO: 25400 - DNA, 384 bp, Gossypium hirsutum
  Clone ID: LIB3272-050-P1-K1-A11
gaaggttgtagaagcagctgcgtgagcttcctaagctacctagggtttccttcattcgaaaatgatttacgacgtcaattctcctctcttccgctctttcctcagccagaagggaggctcctccgacaagagaaaaatggaggagcagaagcctaaggaacagagacccaaagcaaatgagaataagcctgtcatgacagagtaacagctgcttttgtttagtatgaatggcaagttggtggatggttgttcttagaactctgatatgttcgagattggaaatgcttggtgatgtattcaaatactatcacaacgatttttcttctttgagatggaatgatattcaactgtgtggatgatatttaactttttggtatgataggg

SEQ ID NO: 25401 - DNA, 382 bp, Gossypium hirsutum
  Clone ID: LIB3272-050-P1-K1-A12
gcagcagcagtcgcggcggcggcagttctacccagggtctgttttctaaacaaccatcaaacagaaatgaagttcaatattgcaaatccgactactggctgccagaagaagctggaaattgacgatgaccagaaactccgagccttctttgacaagaggatctcccaagaagtcagtggtgatgcccttggtgaggagtttaagggctatgtgttcaagataatgggaggctgtgacaagcaaggttttccaatgaagcaaggagttctgactccaggtcgtgttcgtcttttgcttcacagaggtactccctgcttccgtgggtatggtaggagaaatggagagcgaaggaggaagtcagttcgcggatgcattgttagtc

SEQ ID NO: 25402 - DNA, 261 bp, Gossypium hirsutum
  Clone ID: LIB3272-050-P1-K1-A2
acggttccatgtgaacggcacttgcacatgggttagtcgatcctaagagacgggggaagcccgtccgacagcgcgtccagcgcgagcttagaaagggaataggggtaaaattcctgaacccggacgcggcggctgacggcaacgttagggagtcccgagacgtcggccggggcctcgggaaaaggtatctttttttgttaacggcctgcccacccctgaaacggctcaaacggaggtagggtccagcggtctgaagagcac

SEQ ID NO: 25403 - DNA, 387 bp, Gossypium hirsutum
  Clone ID: LIB3272-050-P1-K1-A3
ctcagaggttgatttctttttcacaagacacaatggcagatggtcatgaaactgacacgaacatcgagatttggaaaataaaaaagctaatcaaggcactagaatctgccaggggaaatgggaccagcatgatatccctcattatgcctcctcgtgatcaaatatcccgtgtcacaaagatgttaggtgacgaatttggaactgcatcgaacatcaaaagtagggtcaaccgtcagtctgtgttggctgccattacttctgctcaacagaggtggaagctctataacaaggttccccctaacgggctggtgctctacactgggacaattgttactgaagatggcaaggaaaagaaggtgacaattgactctgaacctttcaaaccta

SEQ ID NO: 25404 - DNA, 389 bp, Gossypium hirsutum
  Clone ID: LIB3272-050-P1-K1-A4
aattcattctcttcttgagtgtcatttctgaaactggaatctgtatcttgttttaacttccttgagaatgcccatatcttattttcaggtttttcatatgactttatttaaacacaaccctttaaagtaacctaacaccttatcaatgtgctcttatttttattctagattcaaaataacagcagaccaccatggatgattataattgcaagagacgtgggcagatttcagcatctggagactgggatcatgcaactgaattgcccataactcagtactctgaatctgctcgagaagctggttggattggtttaagctcttcatcagcacaaccgataccttatcttactgacgatgggaaaaccaaacatcctcagaatcatgttcct

SEQ ID NO: 25405 - DNA, 365 bp, Gossypium hirsutum
  Clone ID: LIB3272-050-P1-K1-A5
aaaaaagaaaaaatgatgcttggagaaactcatcgtccaaatccaaccgtccacgtaccaccttggcctgatcttgacgatgatcagacggatgtagtttactctcctatccattacaatgcaaccgacaacaacttgagcagtaacggcaacccgttttacctccatgaagcgttatcagctttacaacgttatttgccatcgaacggcccggatgttgagttggattccgagtttccgggtttggatagtccggattcaccggtcgatgcttattcctgtgaccatttcaggatgtacgagttcaaaatccggaggtgtgctcgtgggcggtctcatgactggaccgagtgtccgtacgccca

SEQ ID NO: 25406 - DNA, 390 bp, Gossypium hirsutum
  Clone ID: LIB3272-050-P1-K1-A6
gacctatttgacctgatgacgagaaagtgatactagtgcaaaatagccacggcggggctatcatgtccttagccatgcaatgattacacatgtatggattgctctcttattaattaaaaggtatcatgccacatcatgattattctatggcaactggtgtacctgcatgcttcagaataagtttgacaacgccattcatgatttaacagccatggtgtggagatggattccaagattcaccaactgattcgttatgatgaacaaaacacatcttagtactgggacaataactcgaaccacgagaggatatatgcagaggtctactcgtgggcgagacaatgactggaccgatggaacgatcgcccatggaatcgataatattaaaagaaa

SEQ ID NO: 25407 - DNA, 275 bp, Gossypium hirsutum
  Clone ID: LIB3272-050-P1-K1-A8
ctgcggttatgattatcattatgcggcggaactgacacgtaaaaactgtcgtctaattactgccagcgaaccggactaagcacaacctgtgaatacattgtcgcttgtacatccaatcgctcttgtagaatggtactaagcgacggccctgacagagatccaatatcaagggctgcggtggggggaaataggcttggatagtccgtaccatgtccatccaagatgcgctaagtgctgagtcctttgcaggtgcatgcagccttagtcgttcgagt

SEQ ID NO: 25408 - DNA, 383 bp, Gossypium hirsutum
  Clone ID: LIB3272-050-P1-K1-A9
caacattcccatttccaatctccagctcccaaggtaaatatgccgatcagaaacatagcagttggccggcccgaagaggcgactcaccccgatgccctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatttcacgtggccacgtcaaccccgccgtcaccttccgtgctttcgttggcgggaacatcactctcttgcgcggcattctttactggatcgcccaactcctaagctcaac

SEQ ID NO: 25409 - DNA, 389 bp, Gossypium hirsutum
  Clone ID: LIB3272-050-P1-K1-B1
cggacgcgtgggctttgtcgtttggtttactaattaaacaaaaaaaaagggaaatggccgccgacgccgctgccactgcatcgtcttcggtgacagaggaggagctgaccttgacagtaaaatggagcgggaaagagtacacggttcgagtttgtggagatgactcagtagccgagttgaaacgaaggatctgtgaaatgacgaacgttttaccccaaaggcaaaagcttctttatcctaagatcggaaataagctctcggatgactcccttttgctctctcagatcccccttaagtcttctcttaagatgaccatgattggaactgttgaagatgatataatcgtcgatccagtcgaggcaccggagattatcgatgattttgaactt

SEQ ID NO: 25410 - DNA, 373 bp, Gossypium hirsutum
  Clone ID: LIB3272-050-P1-K1-B10
gcttcctaaaatctacatttcttatctttctttttgctatggcaggtactggagtgggcgatgcattatggggaacacgcactagctgaaacccacaaatgccctttttccgacaagggtggcctatcccaacagctccccggtgggatgatgatgggtgttacactgcgtgaacaagatcacattggtgaaaaacctggagcctgacccgagatggcttttcaacgcgtgcaagccgacataccatcgctacgttgcgattcgcggaagaatgacccacaactgatcagagagatcttgcaggctgacaccattgcactcatggccaaggctcgtattaaccattgcgctgaggcccacatgcttgaagcca

SEQ ID NO: 25411 - DNA, 351 bp, Gossypium hirsutum
  Clone ID: LIB3272-050-P1-K1-B11
gtttcattctgactgtttaggcaaaggatacaatatggcataatggactgatactggcttggctacattgctttcaatgattgctactgatgaaactagaattcctgttgttgattctgacggtgcttgtcaaagtgcccatgccactttctatggcggcagcgatgcttttggcacaatggatgtagcttgtggatatagaaacttatacagccaacgctatagtctcaacacagctgctttgagtactgctcttttcaacaatgggttcagctcggggccctgttttgaaatcaaatgtgtaaaccaaccacaatgctgtcattctgctagtgcttcattttcattaca

SEQ ID NO: 25412 - DNA, 385 bp, Gossypium hirsutum
  Clone ID: LIB3272-050-P1-K1-B2
caacaatgtctcttcactcttctctcaccatgtcattgctgtctttctccttcttgttgctgtttacttttagtgccaaagctgttgttcctccatctgaaacttttaggtttgtcaacgacggagaatttgggccgtttgttgttgaatatgatgcaaattaccgtgtcataagcatagctaatgcccccttccagcttgcgttttataacaccacccctaatgccttcacccttgcgttacgcatggctacaacgcgttccgagtcgctcttccgatgggtttgggaggccaacagggggaaccctgttcgcgagaacgccacgttctctctcgggactgacgggaaccttgtcttggctgatgccgatggtcggattgcttg

SEQ ID NO: 25413 - DNA, 390 bp, Gossypium hirsutum
  Clone ID: LIB3272-050-P1-K1-B3
cttgcatgtaagcatactgcatccgatcatccgcctcggaggtttttaattccatgggtatttgggggattttttacgagcattgtctggttttatatgattgcgaatgagcttgttgctctgttggtagcatttggtgtgatatttggaattaatccttccattcttggagtaactattctggcttggggcaattcaatgggtgatttggtgtcaaatgttgcactggcaatgaatggtggtgatagtgtgcagattgcaatgtctggctgctatgcgggtcctatgttcaacacacttgttggtctgggcatatcattgctgcttggagcttcatcaaagagtccttcctcatacttagttcctcaagatagcagcttgttttacacc

SEQ ID NO: 25414 - DNA, 388 bp, Gossypium hirsutum
  Clone ID: LIB3272-050-P1-K1-B4
aaaatataagaaaaaaaatcatacgcaatgagcactgctggtcaggttattcgttgcaaagctgcggtggcatgggaggcggggaagccactatcgatagaagaagtggaagtggcaccaccccaaaagcatgaagtccgtattaagattctcttcactgctttatgtcacactgatgtatactactgggagtgtaagggttacactcctctgtttcctcgtatacttggtcatgaagcctcagggatcgtggagagtgtgggtgagggtgtgaatgatttgaaacctggagatcatgtgctccctatcttcaccggagaatgcaaagaatgtcgccactgtctgtcagaagaaagcaataacatgtgcgaactgcttaggatcaact

SEQ ID NO: 25415 - DNA, 382 bp, Gossypium hirsutum
  Clone ID: LIB3272-050-P1-K1-B5
gttggctcgtaagctttcttcgcgctctccaagcaagtttgagaaattttattttttagcaatcaacagtgatggcttcatctctagctctcaagaggctcctctcatgcaacatcctccctagctccttgcgggtggtccgcccaatggccatcgctccatcctcctccaggctctttaacaccaatgccatgcgtgagttcgacgacgatggtgatgggcgtgacctcagtgatgaacgccagcgttcactttctcgccgcggtgacggtttcttcacagaggtgttcgatccttttgctccaacatggagcctgagccaagtcctgaacatgatggatcagttcatggagagcccatttctctccgcttcccgtggcat

SEQ ID NO: 25416 - DNA, 389 bp, Gossypium hirsutum
  Clone ID: LIB3272-050-P1-K1-B6
cttggccgttctatatcttccacaacacagaggcagctaagtgagttggtgcgaagatgagtcgtggggcagcagcgggaccccaggggaagaagaaaggggcctcctttaccatcgactgttctaagccggttgaagataagatcatggacatagcctctctagaaaagttcctccaggaaaggatcaaggtcggtggcaaagccggtgctctcggcgattccgtcactgtcacccgcgacaagagcaaaatcactgtctcctccgactccaacttctctaagcggtatcttaagtacttgactaagaagtacttgaagaagcacaatgttcgggattggcttcgagtgatttcttccaacaaggatcggaccgtttacgagctccga

SEQ ID NO: 25417 - DNA, 383 bp, Gossypium hirsutum
  Clone ID: LIB3272-050-P1-K1-B7
cttcactccacatcttatattccttcatttctgtctaaatccttccattttttgatattttttttgtaagtaaaggaacagtgaaaagcaacaggaaatggcaaatatagatatcgatgggatcttgaaggagcttcccaatgatgggcgtatacctaaaaccaagatcgtttgtactttgggtccggcttcacggtccgtacctatgatagagaagctgttgagggccgggatgaacgttgatcgcttcaatttctctcatggcagtcatgagtattatcaagagaccttggataatctgaggtctgctatgcacaacaccgacatcctttgcgctgtcatgcttgacaccatgggccctgagattcgaactggattcctga

SEQ ID NO: 25418 - DNA, 278 bp, Gossypium hirsutum
  Clone ID: LIB3272-050-P1-K1-B8
cagtcttgcataatgcattgccttttttttacccacacctttttttaaacccatttgctaaaaatgcactgggtgcttccagtgttgattgccggtatcggagatactgcactgctcgttgtaactgcgagaagtgggtaccgatcatggtctgacttaaaacccaacagcttcgacttaatgttcggaggctctaagaatatcgagggctcataggagtatatccatataatatatcatatgagtccagtccttactgctaatatgaccagcgcacc

SEQ ID NO: 25419 - DNA, 336 bp, Gossypium hirsutum
  Clone ID: LIB3272-050-P1-K1-C1
cggacgcgtgggtctctctattctctttggcttatctatcgctttgatttcgcatccttgctgtgcactcgatggcaaatcgatggttgaggcctgaggtgtatccgctgtttgcggccgtaggtgttgctgtcggaatctgcgggtttcagttggtgcgcaatatctgcatcaaccctgaagtcagggtaaccaaggagaacagggctgctggggttttggacaactttgctgagggagaaaaatattctgaacatttcttgagaaaatatgtccgcaacaagacgccagaaatcatgcccagtatcaacagcttcttcactgacccaaagtgag

SEQ ID NO: 25420 - DNA, 384 bp, Gossypium hirsutum
  Clone ID: LIB3272-050-P1-K1-C10
tacttaaccatttcccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgcggtggactccttcaatgcaaaggttggggtgtacctccaaacaccctggctgaatatgcacttaaccaatttggaaacatggatttctacgacatttccttagttgatgggtttaacatcccc

SEQ ID NO: 25421 - DNA, 386 bp, Gossypium hirsutum
  Clone ID: LIB3272-050-P1-K1-C11
cgggagggagacgagaaaaggaagacaacgatggtgtctctgaagttacagaagcggctcgccgctagcgtcctgaagtgtggccgtggcaaggtttggcttgatcctaatgaaatcaatgaaatctccatggccaactccaggcagaatgttaggaaacttgttaaggatggttttatcatccggaagcctaccaagattcactcccgatctcgtgcacgcagaatgaaagaggccaagagaaagggtcgtcattctggctatggtaagaggaagggtaccagggaggcaagattgcctacaaagatcctttggatgaggagaatgcgagtactaaggcgtttgcttcgtaagtacagggaatccaagaagattgacaagcacat

SEQ ID NO: 25422 - DNA, 382 bp, Gossypium hirsutum
  Clone ID: LIB3272-050-P1-K1-C12
tacccatggaatcaaagcctttctttcgtttcctctttttcttcatcgccatagctttcctttttctcttcgcctggactcacctccattacgcgccatcccctggcgtcaccaccctcctcgactgtgccagcaactctccttggtgcacctcctccaagaaccggtttcagtccaaacaacccacactcacaaaaaccccacgtgcctccacctcccagcgtcgtcaccacgagtcagctgtccctcgccacccactcgaccccctcaccatccaagagttcaacaaggtccgcaaaatcctttcttcccacgcgctcttcaagtcctccaataactacgcgctccattccgtcgtgctagaagaacccaacaaagaact

SEQ ID NO: 25423 - DNA, 391 bp, Gossypium hirsutum
  Clone ID: LIB3272-050-P1-K1-C2
tcacaggccatgggtatcgacttggtcgccggcggcaagagcaagaagacgaagagaactgctcccaagtccgatgatatctacctcaaactcatcgtcaagctttaccgatttctggtaaggactggcagcaaattcaatgctgtgattttgaagcgtctttttatgtgcaaagtgaacaagcctcctctgcctctatccagattgattgaattcatgaagggcaaggaggataagattgcagtggtagttggaactgtcaccgatgacattcgtatatatgaagttcccgctctgaaggttactgcactaaggttcactaagacagcgagggcgagaattgacaaggctggtggggaatgtttaacatttgaccaacttgctcttcgag

SEQ ID NO: 25424 - DNA, 391 bp, Gossypium hirsutum
  Clone ID: LIB3272-050-P1-K1-C3
cacctccactgcagcaggagcagagggaaaaaggataaaagcatcgtcgcgttctcgcttcttcaactctgtctctacgtctctgaacctcctcctttcgttcttttcttattcagtattgtaaaagatggccgatgctgaggatattcaacccctcgtctgtgacaatggaactggaatggtgaaggctggttttgctggtgatgatgctcccagggctgtttttcccagtattgttggtcgaccccgacacactggtgtcatggttgggatgggtcagaaggatgcctatgtaggagatgaagcacaatccaaaagaggtattcttactttgaaatatcccattgagcatgggatcgtcagcaactgggatgatatggaaaagatctgg

SEQ ID NO: 25425 - DNA, 388 bp, Gossypium hirsutum
  Clone ID: LIB3272-050-P1-K1-C7
cgggcaagagtatgcccaagtgcttcgtatgctaggcaatggccggtgtgaagccatgtgcatagatggtactaagcgcctttgccatatccgaggaaagatgcacaagaaggtttggattgcagctggtgatataattcttgttgggcttcgcgactatcaggatgataaggctgatgtgatccttaagtacatgcccgatgaagcaaggctcttaaaggcatacggtgagcttccagagaacactcgtcttaatgaaggtattgtcgatgaggaagatgaaggaggtgcagatgattacattgagttcgaagacgaagatatcgataaaatatagggttttggaattggttttgtttgaatgatttgcttaaatgttggaagagag

SEQ ID NO: 25426 - DNA, 387 bp, Gossypium hirsutum
  Clone ID: LIB3272-050-P1-K1-C8
gaagttctcatctacgcagcgttccataatcgtcgactttttgaactctctcagcaaccccaagacgacgtcacccccatctgtctcctgctgggggcgaatggactgccaaatacaggggaggttccagcagcgttgttggtaggaaaccaaactcttgatggacaagtactttttaaggcaaagctcttaaaaatttccaacttggaagtttggcttttaaaatttggttttggaattggaaaagcggccaccgttgttttactttccgttgccttgggggcgatgggttttggatgaaccggtgccgtacgcatggttcggttcaagttaagaagagcaagttcccttacgcttgggtaggtaactcggtgagtcagtgtcctg

SEQ ID NO: 25427 - DNA, 380 bp, Gossypium hirsutum
  Clone ID: LIB3272-050-P1-K1-C9
gaaaaacttaatcatggctcggttgacgttggtgacctacatcatccttctgctatgctccggcgccgccggatcaactttcgaggactccaaccccatccagatggtatccgatggcctcagcggcttcgaatcctccgttcttcgcgtcatcggacacactcgccatgctctctgcttcgcccgttgtgcatacaagcatgggaagaggtatgaaaacgtggaggagatgaagctacggttttagattttcaaaggcaacttggatttaatcagatccactaacaagaagggactgccttacactcttgctgtcaatcagtttgctgattggagctgggaagagttccataaacacagattgggggctgctcaaaact

SEQ ID NO: 25428 - DNA, 391 bp, Gossypium hirsutum
  Clone ID: LIB3272-050-P1-K1-D1
ctgattttctctttctaaaaaacgcagcggtgagcgaccggcgagaaaccaaatctcgccggaatttcgctctcttgatcgccggaaatttcatttcctttttcttttcacctctccggaatcaagctgccccaaagagagcggatatatatatatttgaatttcgggtatgattttgtaatcatgtttttgtagaagaaaacaaagagaaaaaggagaacaaagatcttctctctcttttggatatggcgattaaatggagccttgagtgataaattttgagcttttagtttttgagattttctggtgttgaagctgtacaatgccatctgagatcatggatcaaaagaatgcatcggcatcatcccatttttcggaagacgtttgtttc

SEQ ID NO: 25429 - DNA, 378 bp, Gossypium hirsutum
  Clone ID: LIB3272-050-P1-K1-D10
cttcactccacatctcatattccttcatttctttctaaatacttccatttgtttgattttttttaagtgaaggaacagtgaaaagcaacaggaaatggcaaatatagatatcgatgggatcttgaaggagcttcccaatgatgggcgtatccctaaaaccaagatcgtttgtactttgggtccggcttcacggtccgtacctatgatagagaagctgttgagggctgggatgaacgttgctcgcttcaatttctctcatggcagtcatgagtatcatcaagagaccttggataatcttaggtctgctatgcacaacaccggcatactttgcgcggtcatgcttgacaccaagggccctgagattcgaactggattcct

SEQ ID NO: 25430 - DNA, 382 bp, Gossypium hirsutum
  Clone ID: LIB3272-050-P1-K1-D11
ctttttggtttttttttttaaatttctcgaaaccccttttttctcgattatgtttaaatagatcaatggatttcgccaagctaaagcggaggttgtattactggattcatcaagtacgtgatgtctgatattgtgaatatcctacttcgattaatgtggcatctcttacatgtcactatccacttatgctactttgcgatcaatattgcaaatgcgctcgaaagccatcttatatccaagggattacttaggagatacaaatccctccatatatccaagctccagtatctggctattgtgatagaaagcgaagattgccgaacttcgaatgttattgagcttttgcaatggctggcagatcttggtgtcaaacatgtttgcc

SEQ ID NO: 25431 - DNA, 219 bp, Gossypium hirsutum
  Clone ID: LIB3272-050-P1-K1-D12
agtaaacttcctcctcgccaagcaagacttgttgtttacaataaaaggtccaatgagaccagtatattggtaggtgaattattaaaaagttattgctgcaactggggggggccacaacaggggcaaagtattttggtttaaagtggttccggttgtgcaacctccaatggatgctttggaatttgctgaatgggaggctgtggttaaaaactttcttct

SEQ ID NO: 25432 - DNA, 372 bp, Gossypium hirsutum
  Clone ID: LIB3272-050-P1-K1-D2
cagaatcagagtaattcattagcaagcgttgaggtttacggttaagagttctatgctattgacattggctgcgatgtacagtctttacataatgaacaaactagggggggtgatcttttataaggattatggatccaaggggcgcatggatacgaatgattgctatggaggggctagaatatgccatacgatgcacgctatctaacaactgctatcgtctaccactggctgttatggaattgagctacttggatctgatacatgtgatctccattgcttgcaatgtgttaccgcaacacagttctttggcttttgctaacctgctacacaaaacatggatgctctgttgaacgttgagtatcagctctacac

SEQ ID NO: 25433 - DNA, 391 bp, Gossypium hirsutum
  Clone ID: LIB3272-050-P1-K1-D3
gctatccatttcctttgctggagagcttcccagtcctttaaagtttcattaaataaaccaattttaatgtcgtcgtcctcgctctctaatcccgctctctccactcctttcatctgccacaaccttcgtctaaatcagaatacgaaggatgggataaattgttttccctctcttagaaggcatagagtcccaagatgtgcagtggatatgccttacggaggtaatgctccaacttttcctcaaataagagtctgggatccgtataagcggctcggcattagtccttacgcttcagaggaagaaatttggtccgcgcgcaattttctcttagaacaatatgctggacatgagagaagtgaagaatcaattgaagcagcattcgagaaactac

SEQ ID NO: 25434 - DNA, 389 bp, Gossypium hirsutum
  Clone ID: LIB3272-050-P1-K1-D4
attttctcctttttatctttaaaacacgcacccaaaaaataaaaccctttgaaaaccaaagaaggaagaagaagatgtcgtggcaagcttatgtagatgatcacttgatgtgtgaaatcgaaggaaaccatctctctgccgccgctatcatcggccaggacggcagcgtttgggcccaaagcgccagtttccctcagctcaagcctgaagaaattagtgccatcatgaatgactttaatgaaccgggttcactcgctccgaccgggttgcacctcggtggcacaaaatacatggtgatccaaggcgaaccgggagctgttatccgagggaagaagggacccggaggtgttactgttaagaagaccaatatggccttgattatcggaatc

SEQ ID NO: 25435 - DNA, 388 bp, Gossypium hirsutum
  Clone ID: LIB3272-050-P1-K1-D5
gatacactatgtagtacacctgagaggcacgcaattatttctcctcttctctcccgctctatctctgcaactctcgtcaggagctttaacaatggcggactctttgtagccaaagacttccagtttccctctcttccgctcttgcttttcttttctcattagttgccaaaatgcgttccaaggacaaaatatcctacttttacgacggagatgtagggagcgtatactttggacctaatcatccaatgaaacctcaccggctttgtatgactcaccatttggtccttgcctatgacctccataaaaagatggaaatttatcgtccccacaaggcttaccccgttgaactcgctcagttccattcagctgattatgtcgagtttttgca

SEQ ID NO: 25436 - DNA, 387 bp, Gossypium hirsutum
  Clone ID: LIB3272-050-P1-K1-D6
aggaagtccaaaatcagccatccttatccgcgctaaatttctttacctttctcttttccattagtctccaaaagaaaattgatcatcacctctcttaaaatgacctcttctctttacatgttccttctcatctccctaatcttaacatcactcaccaacggagatgctggtttaatccaaaccacttgcaaaaccaccaagtctgctgacctttgtgtctccatccttcactccgatcctaccagtctgaattcagacacaaagggcctggccctgatcttgatccgagttgcaacggctaatgccacggcaacatcgaccttcttatcatcccaattgcttactaccacaaatgacactaccctaaagacagttctaaaagaatgc

SEQ ID NO: 25437 - DNA, 385 bp, Gossypium hirsutum
  Clone ID: LIB3272-050-P1-K1-D7
ctcatcacattttattgtgcttctctctcagatcttgaaaatgtatacatcaatgaagaagatccacaaagataaggatgttgaaccaacagaatttgaggaatcagttgcccaggcattctttgatttggagaataccaaccaggatctgaaaagtgacctcaaggatctctacattaattcagcagtccaaattgatgtgtctgggagccggaaagctgttgttatccatgtcccctaccgattgaggaaagcttttcgcaaggttcatgttaagcttgtgagggagcttgaaaagaagttcagtggaaaggatgtgattcttattgccacccggaggatattgaggcccccaaagaaaggttctgccgttcagaggcctcgc

SEQ ID NO: 25438 - DNA, 335 bp, Gossypium hirsutum
  Clone ID: LIB3272-050-P1-K1-D8
ggcatttataggattatcaagcgctatgcatatgccgacctttatggttcatggagagcaaaccggaacaggaaagggtcaagaaaaactgggtataagtgaaagaattatgaaaccaaagtgcgaagctaggctacaatgcctaatccgggattaaatgctggctataaagatagacgacatggatgatgaaacaatgattacttattcatgggcagtgaagatggatatatggtgggtacacagcatcatagactctctgacataccgagctaaacatagatgaggggtctgccaaagcataacgagccggagcatggtgatggatttaatgc

SEQ ID NO: 25439 - DNA, 354 bp, Gossypium hirsutum
  Clone ID: LIB3272-050-P1-K1-D9
taaaaaatgagctttcttcaggccttgtcaattttccttttgcttttgttgtatgtagtcgtaggatcagctgagcagtgtggaaggcaagcaggcggtgctctttgccccggtggtctatgttgtagccaatttggctggtgtggcagtactgctgactactgcacagttcctggttgccaaagtcagtgcagcggtagtggccctgcccctgggcctggtgggctaaccaatcttatatcaagagagacctttaatcagatgcttttgcataggaacgatggggcttgtcctgcccgtggcttctatacatatgatgctttcattgctgctgcccgttctttttctgcattt

SEQ ID NO: 25440 - DNA, 134 bp, Gossypium hirsutum
  Clone ID: LIB3272-050-P1-K1-E1
cttcttcaaaaaatgggttggaaaggaaagggtcttgggaaggatgaacagggagtaattgagcctataagatctgggattagagatccgtaggtcggcggtcttttttccccggttccttgttttccccattt

SEQ ID NO: 25441 - DNA, 385 bp, Gossypium hirsutum
  Clone ID: LIB3272-050-P1-K1-E10
gagcttttcttttaagctctgcttctctcaattgtttatatggcatctcaagccagtctcctccttcaaaagcagctcaaagatctttgtaagaatccggttgatggtttctcagccggattggttgacgagaacaatatctttgaatggagtgttacgattattggaccacccgatactctttatgaagggggattttttaatgccatcatgagctttccacctaattatccaaacagccctccagcggtgaaatttacgtcagaggtttggcatcctaatgtttacgcggatgggcgtgtttgcatatcaattcttcatcctccgggtgatgatccaaatggttacgagcttgcaagtgagcgctggatgccagtacatacag

SEQ ID NO: 25442 - DNA, 377 bp, Gossypium hirsutum
  Clone ID: LIB3272-050-P1-K1-E11
cgggcaagagtatgcccaagtgcttcgtatgctaggcaatggccggtgtgaagccatgtgcatagatggtactaagcgcctttgccatatccgaggaaagatgcacaagaaggtttggattgcagctggtgatataattcttgttgggcttcgcgactatcaggatgataaggctgatgtgatccttaagtacatgcccgatgaagcatggctcttaaaggcatacggtgagcttacagagaacactcgtcttaatgaaggtattgtcgatgaggaagatgaaggaggtgcagatgattacattgagttcgaagacgaagatatcgataaaatatagggttttggaattggttttgtttgaatgatctgcttaaatg

SEQ ID NO: 25443 - DNA, 383 bp, Gossypium hirsutum
  Clone ID: LIB3272-050-P1-K1-E12
caaaaatctctctcttctcttcctctgtgttatttgcagtcttatgtgttatgaaatttttcatgtttgagactcatgtctgcggttggtagtgaaatcctccgttctgggtttatgataaatctcttcacttagacgaaggactcatcttgttcaatctttctctgatgtttttctttactggttttatgttttctcataaataaattgtcctattttaccatatatacatatatatatataataagtggttgtttagcttacaatttagtctctctttttttcttttttaacggcttcttctagtggaaactccatgtccaattcacgatccgaagaggatctgcacaatcaaaggaaacgtgaaaggatggaatccaacc

SEQ ID NO: 25444 - DNA, 389 bp, Gossypium hirsutum
  Clone ID: LIB3272-050-P1-K1-E2
aaaatatctgctcctcttagtttccctttttgtcccttgtttatttgatactcccccctcatggctgccgctgatgtcgagttccggtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatcgcgcagaagtggaggcggtggcggaggatttggaggaggaaacggtggttacagccgcggtggaggcggcgg

SEQ ID NO: 25445 - DNA, 390 bp, Gossypium hirsutum
  Clone ID: LIB3272-050-P1-K1-E3
cagtcctgttccatgacctaaacacagactcaataaatgtataaacgaaactaatgggatggattgtggggcttattgcttaagggacatactgaagtgtatcacgcattcgctttcttaagtgcaaatataagctggagattgaaactgttagaggaagtggtaccgtctcatgtgcattcatattcagaccattgattaagaaagctgcatatttagcatttctagagaaagatgatgggtgggattcactagacatcataggcaaatgtgggtgggacgtagttttcatggctatattgccaggtactgattggaaattgaaaggtatcaagaagattattcagccgtcagaagatgcaactgattcgtctgatgatgatggcatgc

SEQ ID NO: 25446 - DNA, 387 bp, Gossypium hirsutum
  Clone ID: LIB3272-050-P1-K1-E4
tttcctttttgctcagatctcctcatctctcccactttttttctttcttctaatacccaatggccgtcactttctcaaatctccacaccgagtctggtcttaaagctcttaatgacttcctctctggaaaatcttacatctctgggaataagctgaccaaggatgacataaaagtttatgctgctgttctgaagaaccctggtgattctttccccaatgttagccagtggtataattctgtttcttctcaacttgcggccagcttccctggcaaagctgttggcgttgggtttggtggcaaagctgctccagctgagtctgctaaagctgaggctgcagatgatgacgacgacttggatctattcggtgatgagacagaggaggata

SEQ ID NO: 25447 - DNA, 383 bp, Gossypium hirsutum
  Clone ID: LIB3272-050-P1-K1-E5
aaaaaagagaaaatgatgcgcggagaaactcattgtccaaatccaaccgttcacgtaccaccttggcctgatcttgacgatgatcagacggatgtagtttactgtactatacattacaaggcaaccgacaacaactcgagcagttacggcaacccgttttaccttcatgaagcgttatcagctttacaacgttatttgccatcgaacggtccggatgatgagttggattccgagttttcgggtttggatagtccggattcaccggacgatgcttattgctgtgaccattgaaagatgtgcgaggtcaaaatccggaggtgtgctcgcgggcggtctgatgactggaccgagtggccgtacgcccatcccggagaaaaagctcg

SEQ ID NO: 25448 - DNA, 378 bp, Gossypium hirsutum
  Clone ID: LIB3272-050-P1-K1-E6
caaaaccttaattcgatgccactcaccccgaacaacctatctccaccaacatggggaaaacacgtggtatgggagcggggcgcaagctgaggacccaccgaatgaggcagaggtgggctgataaggcatacaagaagtctaaccttggaaatgaatggaagaagccatttgccggttcttcccatgctaaaggaattgtccttgagaagataggtatggaggctaagcatccgaactctgccatccgaaagggtgctagagttcaattgatcataaacggcatgaagattgctgcttttgctacaaatgatggttgcttaaactacattgaacagaatgatgaggggtcgatggctggattcggactgacgggtcatg

SEQ ID NO: 25449 - DNA, 385 bp, Gossypium hirsutum
  Clone ID: LIB3272-050-P1-K1-E7
caacattcccatttccaatctccagctcccaaggtaaatatgccgatcagaaacatagcagttggccggcccgaagaggcgactcaccccgatgccctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaaccg

SEQ ID NO: 25450 - DNA, 387 bp, Gossypium hirsutum
  Clone ID: LIB3272-050-P1-K1-E9
ctgcaaggaaaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattgtctttgct

SEQ ID NO: 25451 - DNA, 345 bp, Gossypium hirsutum
  Clone ID: LIB3272-050-P1-K1-F1
acaaaaaacatgttttggttcaatacaatcctcatttttctaatgaactcataacgcttgagttatagcaaaacgccggtgtgtaggataaaaacgctgtttacatggtacaccccatggaaagggtatcactggtgctgatgaatgcaccggctccataaggaagcgtatctaatgcattaatgtaccagacattgaataaaacaggcgggctctacacgtgctacgattgactgtttcaggagctctccaacacgttagcgaagctattatctgcgaggacaccgtggataaaaaaaccgtttcgaacaagcactttgcagatgttgtgaacgaaggtgccgt

SEQ ID NO: 25452 - DNA, 377 bp, Gossypium hirsutum
  Clone ID: LIB3272-050-P1-K1-F10
gctttggatacgccatccttgtccttggcatcttcaatgtattcaagggtatcaatatcttgaaacctgaagacaaatggaaaacagcttatatgattgtgattattgccttgggtggtatttcattgctgtttgaagccattacttgggttgtcgttttgaagagaaaatctagaaagtccaccaaaccttgcgacggatacaacaatggccaaagttgatggcatcagcaagcctccaattgcagattttgtaacacccttgtgctttctcatccttgttgggatgttctatttcctattttcagtgtcttgtataattgcttggttccaaatgttggttttttttagcactcgatccttagtacatgttatata

SEQ ID NO: 25453 - DNA, 382 bp, Gossypium hirsutum
  Clone ID: LIB3272-050-P1-K1-F11
atcacacgcccctccgacacctccgctaaaaacagctacttctcaccagatctcttacatccaacggccttgatatctccacgtctccgtaccccaatccattatttgaatctagctctttatttcttctccacatcctccgtcctttcctccactctttttcttacacgaagagaaagaatcaaccggcgccgctgcgattgaccgcctctttcgccgccgccgtacgccgttaatcttgaaggaggagattttggtttgaaatcagacggtcgagatgccgagcacgattcaaaaagcgatcggggccgttaaggaccaaaccagcataggactagcgaaggtggctagcaacatggcgccggacctcgaggtggcgatt

SEQ ID NO: 25454 - DNA, 386 bp, Gossypium hirsutum
  Clone ID: LIB3272-050-P1-K1-F12
caaagatatcactgcaagaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcatt

SEQ ID NO: 25455 - DNA, 375 bp, Gossypium hirsutum
  Clone ID: LIB3272-050-P1-K1-F2
ataatttggtggagactgcatttttttggtatctgcagcgaaagaggcaaggggagatccgatactgaatcaacagcaacagcaatggctagacaagcttcacgacttattcaatctttgtcttccaggatttctcctcacaaacctcaactatccccgctcactccctcttcctcttcttctcagcttttgactcagtcacgctctttctcggcggctccggcgcctcaaccggcggttttcgtagacaagaacactcgtgtcatttgccaagggatcactggaaagaatggcactttccacactgaacaagccatagaatatggcactaagatggttggtggagtaacacccaagaagggtggcacacagcac

SEQ ID NO: 25456 - DNA, 379 bp, Gossypium hirsutum
  Clone ID: LIB3272-050-P1-K1-F3
cgtggagagccttttttgtgtagcgattctcagttagtcttttctttaagcttacagcttctctccagagttttataatgggtaaggagaaggttcacatcaaccttgttgtcattggccatgtcgactctggcaagtcgaccactaccggtcatttgatctacaagcttggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaa

SEQ ID NO: 25457 - DNA, 389 bp, Gossypium hirsutum
  Clone ID: LIB3272-050-P1-K1-F4
ctttcgacattctctggcgttttctcaaaaaaaaaaaattctgacaaaattttttctttaattttcagctttcttccttttacattcttcgtaattccaatctatcatcacataaacaaagaaaaaaaaattctgggtttcttatcgaatctccaaatctttctctttcattgaagaaaaaaattgaaaaacatgtgtcctatgaggttcttgttggtgtttttctcggcgattttagctgggtatttcgcttggagaacggcggtgggttcatcggttgatgccgatgatggggtttctgaagtttcaaggacaattgttgccaaaaatgaacaagatttcagtttcaaaatgatggttaagaatggattctgggtattggttgatat

SEQ ID NO: 25458 - DNA, 390 bp, Gossypium hirsutum
  Clone ID: LIB3272-050-P1-K1-F5
agtgaactgaaaaaagaaaacccggaattttaaagacaaaaaaatgccttcttctccgttgattcttctctcaaaaaccatgattttcccagaccaaaaatcaaaccttgaagacctcaagctttcagtttccgatcttcctatgctatcttgccattacattcaaaaaggttgcctctttactcgcccttcaatccccattaattcactgatttcccttctcaaacaatccttgtccaagacgctgtcgtttttccctcctctcgccggccgtttttacacagacccaaatggttacatttacattacttgtaacgacgccggcgttgaattccaccatgccaaatgtgacaccaagttcatccgtgacgtcatcggtccggttcatgt

SEQ ID NO: 25459 - DNA, 388 bp, Gossypium hirsutum
  Clone ID: LIB3272-050-P1-K1-F6
ctcaactccgtctcccttcttctcctaaaccttgcagagctgttattgccatgtccggctctgggaagttctttgttgggggtaactggaaatgtaatggaacaaaagactccatcacgaagcttgtttctgacctgaacagcgcaaagttggagagtgatgttgatgttgttgtggcacctccctttgtctatcttgatcaggtgacttcttcattaactgatcggattgaggtatctgctcagaactcttggattggaaaaggtggggctttcacgggagaaatcagtgtggagcaactgaaagatattggctgcaaatgggtcattcttgggcattctgaacgcagacatgttattggtgaagatgatcagtttataggaaagaa

SEQ ID NO: 25460 - DNA, 385 bp, Gossypium hirsutum
  Clone ID: LIB3272-050-P1-K1-F8
gattcttccgagattcatcagagtttgatttctgaggggcaaaggtttgatcaagaaatggaggttcatgatacgagggactcactggaggaagacaaccttaatcttttacaagccatggccagtgtgtacttatggattttgttctttgccatggcatgtggcatggggtcggggcttgccacggtgaataaccttggccaaataggagaatctcttggttactccaactttgagaacaacactttggtttccttgtggagcatctggaattttctaggccggttcggggctggatatgtatcggatcatttcctgtatgttaaaggatgggcaaggccattgttcatggtgctaaccctgtcaagcatgagtgttggtcatg

SEQ ID NO: 25461 - DNA, 383 bp, Gossypium hirsutum
  Clone ID: LIB3272-050-P1-K1-F9
aaaaaagagaaggatctgatgtacctgccggttgatcttaattatacacaagatcatgatggcccttgaaaataaagaaactatgcagaactgcgaggcaaccttaaaatgcctccagacgaaggggttcccgtacaacctgcgatgtactgggaactcaattgaaggccgtccagagcttaaagatgaaatttgtactcacccaggtggggatgttgtagaacctgtttgctctttaaatgggcagtttatggaataccacaaacctacccttcggcatgagtctggctcttggtcgaccttctatcctgacacccacaagttgcagccatacccaccaaatgcttttggggggcagttttaccactttcccatggataacc

SEQ ID NO: 25462 - DNA, 388 bp, Gossypium hirsutum
  Clone ID: LIB3272-050-P1-K1-G1
tctctctctctctctctctctctctctctcatggattctctttctctcttctgtaccggggctcttttagccggcggtctgtactggttcgtttgcgttttaggccccgcagagcagaagggcaagcgagctgtcgatctctccggcggttccatttccgctgaaaaggttcgagacaactacaagcagtattggtctttcttccgccgcccaaaggagatcgaaaccgccgagaaagtcccggacttcgtcgacactttttacaatctagtcaccgatatatacgaatggggctggggtcaatcctttcatttctctccttccatccccgggaaatctcaccgtgacgcgacgcgtctccacgaagagatggccgtcgatctcatcg

SEQ ID NO: 25463 - DNA, 387 bp, Gossypium hirsutum
  Clone ID: LIB3272-050-P1-K1-G10
gaaagatttccaagcaaacaaaaatccccaagcggaatccaagaagacgacgataccgccttacatgaaagccatttcaggctccttcggcggtatcgtagaagcctgttgtttgcaacccatcgatgtcatcaaaaccaggttgcaattggacaggatggggaattacaaagggatcgttcactgcggcgccaccgtgtctagcaccgaaggggtgcgggctctttggaaaggattaacgcccttcgctactcacctcacgcttaagtacgcgctccggatgggatccaacgccatgttgcagagcgcgttcaaagactcggatactggcaccttgagtaacaaagcgaggtttttatctgggttcggtgctggggttcttgaggc

SEQ ID NO: 25464 - DNA, 368 bp, Gossypium hirsutum
  Clone ID: LIB3272-050-P1-K1-G11
aactgtttcctttggacagttaagtgaaaagatgccgtactactcgaggggtggcgaagatgacgttgacgagttcgacgaatttgatccgacgccttacggtggtggatacaatcttgacctaacttacggacgtcctttggaaccctgcgatgagacttgctacccttccgctacaccctccgatggcgactttgattatgcacgtaccgatttctctttcggttacgcgcacttagcttatgccgacgaagctcttgaaactgaatacagtagctatgttaaacccaagccccgacctggacgattcgaacctgcacctgcttttggtgctggatctggtgactatggaaagaaacctgaatatg

SEQ ID NO: 25465 - DNA, 386 bp, Gossypium hirsutum
  Clone ID: LIB3272-050-P1-K1-G12
ggagggtcaacaatggctttgtatcttgtacgagcaatcaaattaacaaacacaataagaacaaccaccctactacttagaagctcaaatacccaaacccgcaacatctctcactttctcgtttctcataaccaattaactccccgttcccaaaacctcactcctttctgttcatttgattttcttagagattctcgccgtggtttcgccaaaggaaaaaaatcaaaggatgattctggtgggagtacaatggaacttgctcctgatattgggccttctgttaaagcaagtgctgcatcacagatggatgcagcaatagttgccttatcgcgggagctagccaaattgagaacaggaagggcatctgcaggaatgcttgatcatat

SEQ ID NO: 25466 - DNA, 391 bp, Gossypium hirsutum
  Clone ID: LIB3272-050-P1-K1-G2
ccaaagtagcagtgatcatgacaaggctaaacagctgctgcaacgtgtccgaggcaccactgatgtcgaagcagaactcgaggatctcatcaaagcaaggtcaatctcaaaaaccatcaagcacccattcaagaaaatcatacaaagaaagtataggcctcaactagtaatggcaatagccataccatttttccaacaagtgacaggcatcaatgtcattgcattttatgccacacttctattcagaacaattggaataggtgaaagtgcttccctactctcctctgtggcaaccggtgttatcggagccggatcaacattcatatcaatgcttatcgtcgataaattcgggcgacgagccttattcatggttggaggaatccaaatgctt

SEQ ID NO: 25467 - DNA, 390 bp, Gossypium hirsutum
  Clone ID: LIB3272-050-P1-K1-G3
ctctcctgctcgctgcgatttcgcctgcaagatctcaattttcaaattgtagcgccctttttatcaagcaatggctctggtcttgcatgcaggaaaaacaaacaaaaatgcctttaaggcactcattgctgcagaatatagtggtgtgcaggtcaaaatggttgagaattttgagatgggtgtgtcaaataagactcctgagttcatcaagatgaaccctttggggaaggttcctgtgttggaaacacctgagggtcctgtatttgagagcaatgccattgctcgttatgttgctcgcttaaaggttaacaaccctatatgtggttctacattgattgattatggtcatatcgagcaatggattgattttgcagccatggaaattgatgc

SEQ ID NO: 25468 - DNA, 282 bp, Gossypium hirsutum
  Clone ID: LIB3272-050-P1-K1-G5
gacggaacgattttcaagcaaacaaaaatgcccaagcggaatccaagaagacgacgataccgccttacatgaaagccatttcaggctccttcggcggtatcgtagaagcctgttgtttgcaacccatcgatgtcatcaaaaccaggttgcaattggacaggatggggaattacaaagggatcgttcactgcggcgccaccgtgtctagcaccgaaggggtgcgggctctttggaaaggattaacgcccttcgctactcacctcacgcttaagtacgcgctcc

SEQ ID NO: 25469 - DNA, 342 bp, Gossypium hirsutum
  Clone ID: LIB3272-050-P1-K1-G6
agatgacctcatctcttattgtataacgattccaccaaacaatgcaactggggtagactacctacgtattgcctgatcgagttctccgtctgtgcacgcaaagaaattgataagggagtggaatttgtttcctaaagaggaagttaacctggtcgatcgaggccgagtttcgttaccccaggattcgaagctggtggaaaagcggttcaagttccccggtttggaagcccttggtggggtttctgtttacgattagagtcatcatgctggctattacaagcttcctaattcttatgatgccagaatgttctatttcctttttgaattactcattatcaatga

SEQ ID NO: 25470 - DNA, 383 bp, Gossypium hirsutum
  Clone ID: LIB3272-050-P1-K1-G7
cttcactcttctctcaccatgtcattgctgtctttctccttcttgttgctgtttacttttagtgccaaagctgttgttcctccatctgaaacttttaggtttgtcaacgacggagaatttgggccgtttgttgttgaatatgatgcaaattaccgtgtcataagcatagctaatgcccccttccagcttgcgttttataacaccacccctaatgccttcacccttgcgttacgcatggctacaacgcgttccgagtcgctcttccgatgggtttgggaggccaacagggggaaccctgttcgcgagaacgccacgttctctctcgggactgacgggaaccttgtcttggctgatgccgatggtcggattgcttgcaaagtaac

SEQ ID NO: 25471 - DNA, 384 bp, Gossypium hirsutum
  Clone ID: LIB3272-050-P1-K1-G8
gaaaaacccggactctcttccgttttgaataccacccgaacattcactttgcaaatattcagacggtagtaaagtgtaaagtgcatgaacgatcactgcgacgtgtagaatctatgatcatgagtcgtatgggaaggtgaataatgcgaactatgtaccaacttgcccttccaaaacgcaactgattaccattgataacattactacaaatcgaacggtttgaaaccattaaggcgactatgtaaaagaagggagcgcgatgtaccgggtcgctcttaaatttcaaccaccgtctactgtagaaggggagcctgcactgccgttccgtattagttcaataagaacagtgcgcgcgcctatgaacgatatgaatactaagagcga

SEQ ID NO: 25472 - DNA, 349 bp, Gossypium hirsutum
  Clone ID: LIB3272-050-P1-K1-G9
ctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggact

SEQ ID NO: 25473 - DNA, 371 bp, Gossypium hirsutum
  Clone ID: LIB3272-050-P1-K1-H1
tgagggctgggcacgggggtcccagtcccgaacccgacggctgccggcgcgggtatttaccggcagcgaaccggtaaaagcccattttgagaatcggtcgccttcggcgtccaattggtattttgaaaaagcttcctcagtgcttgaccggtcccaattcccttgaaaagggcccccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggactttgaaaagagagtcaaagagtg

SEQ ID NO: 25474 - DNA, 382 bp, Gossypium hirsutum
  Clone ID: LIB3272-050-P1-K1-H10
acttgtacctttttaactctaaagccaagaaagtaagccactaaggttttgagagaagatcaaaatggcttctaaaagatcagcttccatggtcctccttttggcactcaacattctctttttttccctagtcagtgcttgtggctcttgctcttcacccacccctaaaccaaggccaaacccaaaccccaacacccccactcctactccatctgcacgaggcaggtgccctagggatgccctcaaattaggtgtatgtgccaatgtgcttaacctagtcaatgtcaccattggttcacccccagtgatgccatgctgttcccttctcaatggccttgtcgacctcgaagccgctgcatgcctttgcaccgctatcagagct

SEQ ID NO: 25475 - DNA, 385 bp, Gossypium hirsutum
  Clone ID: LIB3272-050-P1-K1-H11
agcagcacacacacatactaacatctatggggagttcagggcaggaggtctgctggaaattggcggatcacccaacacttccaaaggggaagacccttgctctcatcgttctcgatggctggggcgaggacaaacccgatgagtacaattgcattcatgttgctcaaactcccaccatggattctctcaaacagggtgcccctgaaaagtggagattaatcagagctcatggtaaggctgtagggctccccacagaggatgacatgggaaacagtgaagttggtcacaatgctctcggtgcaggtcgcattttcgctcaaggggctaagcttgttgatattgctcttgcctctggaaaaatctatgaaggagaaggattcaagta

SEQ ID NO: 25476 - DNA, 393 bp, Gossypium hirsutum
  Clone ID: LIB3272-050-P1-K1-H12
ccacgcgtccgcctatactctctgattatctctcttcttcgagccgctaggtcgtactgttttagcttcaagtctctcttttttgaaagttcctagttaatactggataatgggtaaggagaaggttcacatcaacattgttgtcattggccatgttgactctggaaagtcaaccacaacgggtcacttgatatacaagcttggaggtattgacaagcgtgtgatcgagaggttcgagaaggaagctgctgagatgaacaaaaggtcattcaagtatgcctgggtgctcgacaagttgaaggctgagcgtgagcgtggtatcaccattgatattgccttgtggaagtttgagacaaccaagtactactgcactgtcattgatgctcctggaca

SEQ ID NO: 25477 - DNA, 65 bp, Gossypium hirsutum
  Clone ID: LIB3272-050-P1-K1-H2
acccacgcgaacggcaaaaagcgccaaacacccggggcccaaaggagaacacagcaaaaggccgg

SEQ ID NO: 25478 - DNA, 379 bp, Gossypium hirsutum
  Clone ID: LIB3272-050-P1-K1-H3
aatttttcctcttttgggagaaattttgatgccgcaaaaatttttaattaggtttattgggtttaatttgctgcggtttgtacttaaattgaaagcaccttttgggaattaaagctagatctcacaagttctacttaatggcataacctagttttttttcttttggaagatgatcctttcatctttgtgcttagatcatagtatatatctatttttccctaaaaaggctgatattttgccttatgttgaaatttgatcatggcattgaggcagcggactcatatgcatcataggggttcaaaagggattactcattgtctattagcatggagggagaggccatgaatttgacatattaaatagttggttctacaaatta

SEQ ID NO: 25479 - DNA, 383 bp, Gossypium hirsutum
  Clone ID: LIB3272-050-P1-K1-H4
ggagacgacgcgctcgttgagggccaaggaaggaaggaagaagagagagagagagataaaaaggagaatctgcttcaaagtttcaaactttcccgtctcatatctaatccccaatttctctcttctgctctaggttccttcctgtcctcttaggattcttgtggtctgttcaaagccatggcctcgaagcggattttgaaggaactcaaggatttgcaaaaggatccacccacttcttgcagtgcaggacctgtagctgaagacatgtttcattggcaagcaacaatcatgggcccttccgatagcccttatgcgggaggtgtatttttagttagtattcattttcctccagattatcctttcaagccccctaaggttgcatt

SEQ ID NO: 25480 - DNA, 390 bp, Gossypium hirsutum
  Clone ID: LIB3272-050-P1-K1-H5
cttcattctactccatcttcactccccctcctcacccaaaccctacaaaatggccgccgccgcgcgccctcttgtctccgtccaaaccatagagtccgacatggctactgatgccactccaaccgttcctctcgctgatgtgatgaaagcctcgattcgacccgacatcgtcaccttcgttcacgacaatatatccaaaaacagccgtcaaccctatgccgtctccaaacgcgctggtcaccaaacttcagctgaatcctggggtaccggtcgtgccgtctcacgtatccctcgtgttcctggtgggggtactcaccgtgcaggccaaggtgctttcggaaacatgtgtcgcggtggacgcatgtttgctcctaccaagatctggcgccg

SEQ ID NO: 25481 - DNA, 265 bp, Gossypium hirsutum
  Clone ID: LIB3272-050-P1-K1-H8
agaagaggaagaagagatggcagtgagcgcaacggtgatcggagcactactgggactgggcacccagatgtactacaacgctctccgcaagctcccttatatgcaacatccgggaaagcacctgttggggatgggtctgggagacgatcacgtaactcagaacgtgaattgtcatggggaattccaatgttaccttaaaacaaagcattttaagggtccgggtggaagctcacgcaatgttcattttttgcccagtgctttgaat

SEQ ID NO: 25482 - DNA, 185 bp, Gossypium hirsutum
  Clone ID: LIB3272-051-P1-K1-A1
gaggaagtttcagaaccctcaagtataaggaatcattgggccggcatctagaattctcgttatttgcaacaactaagcgaagcgagacaaaaatggcgacttcagccatgtcggaaaaacgggtcgtcctgctctgcggcgactatgccgaggactatgaggttatggtccctttccaggctctg

SEQ ID NO: 25483 - DNA, 411 bp, Gossypium hirsutum
  Clone ID: LIB3272-051-P1-K1-A11
acaaacttttcctggtccaaaatgccacagctctcagccgcttgccaatggctgccctaacattcattcaccaaaatcttcttcactctactccgaaactcacgacctcaaaaccaaaccttaaacccaaaagaaccaaaaccaaactctctatccaaacaattagagagtctccacaagcttcttttactgatcaatttgttctccaattagctgactcattagaagactctctcccttcttcttcttcttcttctttgccacttcaaaagcttagagacaactcctctgaaacccttctttcaactcaatggccctctcggaaagacgagtcttttcgcttcacagatacgtcttttatcaagaattcagatataaacccaatttctcacccaccaaattcccttgatt

SEQ ID NO: 25484 - DNA, 413 bp, Gossypium hirsutum
  Clone ID: LIB3272-051-P1-K1-A2
ttagtgatggggtaactcatatatgtaatttactacttcgatgctctcaagggtgctattgattgatctaccatcaaataaattcttggttatcgtttgatcttgttcatccatcttcatcacagattaaatttgattccccagttatggtgtaaagttaacactgttgaagcagctatttataaaccctaatttttttttcttgttgaatttagctctttgatcttaaaaccttcgacccggttcttgtttttgtgtgttggatttagcttgaaacgctggcgaacccttggtgggctaatcaggtgagcctaccgggtatggacccggcaggcaattcaccagctttaaacaaacgtgaccttgaaatttctatgaacgatgctaacaaaagtagaagcaacggaagaggg

SEQ ID NO: 25485 - DNA, 413 bp, Gossypium hirsutum
  Clone ID: LIB3272-051-P1-K1-A4
caatttgctctgaagatcatgttggctatttttcacaaggcatttgctaatccaccagaggagctgaatagtccagcttctcataaatctaccaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgcctcttcttagggagcttgaacaatctatttatgctgaatagacaatatggtctttccaaagggagcaatgaggcgatgtttgtgattgaagcatataggacgctgagggataggggtccataccctgctgatcaggttgttaaggatcttga

SEQ ID NO: 25486 - DNA, 415 bp, Gossypium hirsutum
  Clone ID: LIB3272-051-P1-K1-A5
tttttaacaaccaaaaccttagtttgcataatatagcacaagtgtactaattaaactgcttgtaaagtttgacaaaaaaagttacagcaagtaatacaaagctttaagttaaaaagaaagtgagtaaagaaagatgttcagacactcttctcgtaagataatatcagaattacatacccataatcatgtagcttttggtacgagcgagaaccggagagtccatccatcatccgtaggtcgagatgagatccttgatggtgttgttgctatctcactcagagccatctgggtatggatccaatgcatcttgcttgccgttaacgaagaattctaccactgctttcattcttcgaagcttatccgggtggtaatttacgtgaacgattacgggttttaacttcttgagtttagcatc

SEQ ID NO: 25487 - DNA, 400 bp, Gossypium hirsutum
  Clone ID: LIB3272-051-P1-K1-A6
atccgaaacgccgtcgtcttagtcggaaccacttcgatccacaatgtcttctactttcagcggcgatgaaacggcaccgttcttcggcttcctcggcgccgctgctgctctcgtcttctcctgtatgggagctgcatatgggacggctaagagcggtgttggtgtggcttcaatgggtgtgatgaggcctgaattggtgatgaaatctattgtaccagttgttatggctggtgttttgggtatttatggcttgattatcgctgtcattattagtactgggatcaatcctaaggccaaatcgtattaccttttcgatggttacgcccatctttcttctggtcttgcttggggccttgctgggctttctgctggaatggcaattggaatcgtcggcgatgct

SEQ ID NO: 25488 - DNA, 246 bp, Gossypium hirsutum
  Clone ID: LIB3272-051-P1-K1-A7
aaacttatctaggtagatgactactataataggccggcggatgctatggtgacatgcattgaagcttggaatgaactgaacccatcgggcgcatattcgcaggccgatttctaatggcgcttccacgtcaaaacacattattgggtcaaacgcttatcttgcgggctggggggagaaccatgaatgtgtgttactacacatctcatagggttgagtcatatatactgagcttagctgtacaatagg

SEQ ID NO: 25489 - DNA, 301 bp, Gossypium hirsutum
  Clone ID: LIB3272-051-P1-K1-A8
gcttcctctcccattcacgcgatttctcaatccctcgttttctcgttccgattcctattgatattttttattgaatctgggatataactctacccatgaaaccatataacattcaagattcctaatggcacatgcaaattcaatacacatttttgagggaaacaccattcttgcagacatgagggaaaaccattaatatctgttactacatatatcataaggtttaatcatatatactgagcatagatcaacaataggaaatcaatggatcgatgtcttgtatcagactttaagagttaga

SEQ ID NO: 25490 - DNA, 401 bp, Gossypium hirsutum
  Clone ID: LIB3272-051-P1-K1-A9
cttcattttcctctgaattctttgtctctatttaaaaaaaaagagcaatttttttgaggtggtagtatacaaaaacaaaatgaagatctgttgcattggagctggttatgttggtgggcctacaatggctgtgatcgcgcttaaatgtccggatattgaagtggctgtcgttgatatctctgtacctaggatcgctgcctggaacagtgaccagctccctatctatgagcctggtcttgatggtgttgtgaaggagtgtcgtggcagaaaccttttcttcagcactgatgtagagaaacatgtgcgtgaggctgatatagtctttgtttctgtcaacactcccaccaagactcgggggctcggagctggcaaagctgcagaccttacatattgggaaagtg

SEQ ID NO: 25491 - DNA, 417 bp, Gossypium hirsutum
  Clone ID: LIB3272-051-P1-K1-B1
aaaccccccaaattttccctcgttccttgaattgtttgaacactcttttgtaaaaaaaaaaaaaaaaaaaaaaacagttgtgttctttgaaaaatcaaggaaactgtgtttttttattctagctggaaaaaaaaaacatgtatgccgacacagggctgttttttccttacatgcagaactttgctcaagattttcagcagtttgaaggttactgtaaaacccataaaccgaatgcttcaatgaacaacatggttccgacctcgacgatatcggaatatgatttgggaggagatggtgatttgttcaaagctccagaaccaatcatcgaagaaccaattgtaagccttgatccgatgactgcagccatatcatcgttagtctcgtgcggtgaagatgttattacttcgcaagaactta

SEQ ID NO: 25492 - DNA, 409 bp, Gossypium hirsutum
  Clone ID: LIB3272-051-P1-K1-B10
caacaatgtctcttcactcttctctcaccatgtcattgctgtctttctccttcttgttgctgtttacttttagtgccaaagctgttgttcctccatctgaaacttttaggtttgtcaacgacggagaatttgggccgtttgttgttgaatatgatgcaaattaccgtgtcataagcatagctaatgcccccttccagcttgcgttttataacaccacccctaatgccttcacccttgcgttacgcatggctacaacgcgttccgagtcgctcttccgatgggtttgggaggccaacagggggaaccctgttcgcgagaacgccacgttctctctcgggactgacgggaaccttgtcttggctgatgccgatggtcggattgcttggcaaagtaacactgccaacaaagg

SEQ ID NO: 25493 - DNA, 408 bp, Gossypium hirsutum
  Clone ID: LIB3272-051-P1-K1-B11
ctcccactttatcatcatcactgtctctttagcctttaccctttgtttcgttgatttgtttctaaggatttaatctccaaaccttcttcccatttcttcattacattgttcaagaaaaaagaagcaaaaaaacatggccaaagttctgttgttcattgcactatgtgtgcttccagctttggttagtgctacacgcattctgaataatcaattggtggtagaaggctatgtgtactgtgatacttgccgtgctggttttgaaacccctaagactagaagcctagctgatgccatggttaggttggtatgctccgacaggaagagcggccaagttgtcttcaaaaaggagggatacaccgacaaaaccggaaaataccagattcgtgtatcccaggatcacttggatca

SEQ ID NO: 25494 - DNA, 406 bp, Gossypium hirsutum
  Clone ID: LIB3272-051-P1-K1-B12
caaagaaccggttcctcaatctctctaatcctcactttcttccccatcaaacacaccttcgattttcccaaggttgtagaagatggcagaaggtgaggatattcagccacttgtttgtgacaatggaactggaatggttaaggctggatttgctggggatgatgctccccgagccgtattccctagcatcgttggtcggccacgtcacaccggtgtgatggttggcatgggccagaaagatgcatatgttggtgatgaagctcaatcaaagagaggtattttgactttgaaataccctattgagcatggtattgtgagcaactgggatgatatggaaaagatttggcatcataccttttataatgagcttcgtgttgccccggaagagcacccagttctccttact

SEQ ID NO: 25495 - DNA, 415 bp, Gossypium hirsutum
  Clone ID: LIB3272-051-P1-K1-B2
cttcttctctctttttctcattcattctttagtttcaatatcaaagcaaaaatgggttcttcttgtaatgttgtttcaatggccttactggcttgtttggtgttgaactccttggttttttgtgcccacggcggtgacttttaccaggatttggacctaacttggggtgacacaaggggcaagattttcaatggtggcaagctcttgtctttgtctttagacagggtttcagggtctggttttcaatctaagaaagagtatttgtttggaaggatcgatatgcaactcaagcttggtgctggcaactcagctggcactgtcactgcttattatctgtcatctcaagggccaacccatgatgagatagactttgaattcttagggaatctgagcggtgacccttacattttacaca

SEQ ID NO: 25496 - DNA, 419 bp, Gossypium hirsutum
  Clone ID: LIB3272-051-P1-K1-B3
tgaatctccaaatcgaaatttaaggccaaaaagacacaagggttactaattaaattaatcttcagcgaatatgttggtttatcaggatcttcttacaggtgatgagctcctctcggactctttcccatacaaagaaatcgagaatggaatgttatgggaagtcgagggaaagtgggttgttcaaggagctgtcaatgtagatattggggctaacccttctgcagaaggtggtgatgatgatgaaggtgttgacgatcaagccgtcaaggttgtggacatcgtcgacactttcagacttcaggagcaacctgcttttgacaagaagcagtttgtgaccttcatgaagaggtacatcaagaacttgacacccaaattagagcctgaaaagcaagagtctttcaagagaacatcgaggggct

SEQ ID NO: 25497 - DNA, 82 bp, Gossypium hirsutum
  Clone ID: LIB3272-051-P1-K1-B4
tagactgcgtaatttgggtgattaacttatgagacgggacgagctttaccgtaagtaatatagccagcttagttgcactctt

SEQ ID NO: 25498 - DNA, 460 bp, Gossypium hirsutum
  unsure (1)..(460): unsure at all n locations
  Clone ID: LIB3272-051-P1-K1-B6
tttagaagaaaaaaaatggagagaaaatctcaagccaaaccaattctcttcttctttgttttagtttcggcactaatcgaaacttcctacgccggtgacatcgccatctattggggccaaaaatggtaacggagggtacccctgagtggataacatgtgcccaccgggcaggatataaaataccgtaaacatagggttttccttaaccacctttcggcaaatgggtgcccaactcctgggacttcaaaacttggcccgggtcaacttgtaaatcccaggcatcccaacgggttgggcacctctctnnntagcggtgaaaataaaaaagggttgtnncaaaaccaaagggaatcaaggggtcatgcctctccnncttggaggggtggcgcccgggaagggctactcacttttcgcttctcaaggaagaacccgccaaaaagcggtagctggaattatctat

SEQ ID NO: 25499 - DNA, 414 bp, Gossypium hirsutum
  unsure (1)..(414): unsure at all n locations
  Clone ID: LIB3272-051-P1-K1-B7
gtggagagcctttttttgtgtagcgattctcagttagtcttttctttaagcttacagcttctctccagagttttataatgggtaaggagaaggttcacatcaaccttgttgtcattggccatgtcgactctggcaagtcgaccactaccggtcatttgatctacaagcttggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactntatcaagaacatgattaccggtacctcacaggctgactgtgctg

SEQ ID NO: 25500 - DNA, 408 bp, Gossypium hirsutum
  Clone ID: LIB3272-051-P1-K1-B8
ttcttcctcaatttaccaaatccctagtgcttttaaattggttcatattggtttttagctgtacgaagaaaaatctcttgactgtgtcgtgcagataaaggatgagtacactggatgcaactagagcagaacttgctcttgtagttttgtatttgaataaggctgaagcaagggataagatatgcagggctatacaatatggctcgaaattcctaagtgatgggcagcctggcacagcacaaaatgttgacaaatcaaccagcttggcacggaaagttttccgtctttttaagtttgtgaacgatttgcatggtcttattagcccagttcctcaaggaactccccttccacttgttctgctaggaaagtcaaagaatgcactgttgtcaactttcttatttctcgatc

SEQ ID NO: 25501 - DNA, 395 bp, Gossypium hirsutum
  Clone ID: LIB3272-051-P1-K1-B9
ggagctttcgttttaaaacgaggaatcaacatttaagtggcggctcgcggggacacagtgaatagggaaagatggaagaaggatgcgaaattttgcagctctacgaaattccgtactcggatctcttgcttctatcatcttcttccgcatcgtgttcccattatcaagagagaatgataatggaaaacctggggccgacgggccctggcctcttcgctattacaaacgttcccgacgcttcgcttctccgacgaaagctcctccctcttgctcgcaagctggctcttcttagccccgatgatcgcaaacgtattctcagagaccacaacttggggagtgatgttccattgaaagacccagataggaatgtctactctgtcgcgatgcaactcaaa

SEQ ID NO: 25502 - DNA, 362 bp, Gossypium hirsutum
  Clone ID: LIB3272-051-P1-K1-C1
ctttggaagcatggacttcatagctactatcctgtttctagctcttgtcatctcctacaccaaagctttggacccttgcggccctcatccagatgactcggaccttttggtcatcccaatctatggcaaatgttcaccattcaacccacccaaacctgactcatggttcaacacagtcatgaacatggcttcaaaagacccaacatgggtcaagtacttgtcgtgccttgtagcccaaaagaccactgcggtttccattgcttgacgccaacaggtcctaaacattgtccactatatcgtccgggtaaaagatggcacttctggtcacctcatgtttatggtattggacactagcaatgatg

SEQ ID NO: 25503 - DNA, 404 bp, Gossypium hirsutum
  Clone ID: LIB3272-051-P1-K1-C10
ccaacatatcctcgaacgtatgatctgcttcatgcaaatgggctcctctcacatctcacttcagagaggtgtggcttgatggagttatttatagagatggatcgaattcttcgtccggagggctgggttgtgctctctgataaattaggagttatagagttggcacgtgcacatgctacacaaatacgatgggatgcaagggtgatcgaccttcacaatggcagtgacaagcgcctacttgtttgtcagaaaccttttgtgaagaaatgattgctttagcgccaaaaggtctcaagaccacagatctgtaaacttttcttgatctgaggatgaactatcggtggcatcacaatgttagatatgctccagagtttcgacaggttcgatattaatgacttgagaag

SEQ ID NO: 25504 - DNA, 401 bp, Gossypium hirsutum
  Clone ID: LIB3272-051-P1-K1-C11
aaaatactaaattataaattccctttgcaaacccaaaaaagctcgaagtgaacgaagcagcagcaaaaatggtgctcacaaccactaccccagcgcctgagcagtatgttgaatacagtacctttgcttgcagatatgtacgccaacctgttcccaggctccagatgccaaaaaattcaatgcccaatgaagcagcctatcaagtaataactgatgaactgatgcttgatggaaatcccaggatgaacttagcataatttgtgaccacatggatggaacccgagtgcgataaactcatgatggcttcaataaacaagaactacgtcgacatggacgaataccctgtcaccactgagcttcagaatcgatgtgtcaacatgatatcaaacttatgtaatgct

SEQ ID NO: 25505 - DNA, 400 bp, Gossypium hirsutum
  Clone ID: LIB3272-051-P1-K1-C12
aaaatcttgccttcttttgagatttgctgatgattcatatgtagaaagttacataagcaccatgggggttgattttaaaatacgcactgtggagcaggatgggaagaccattaaacttaaaatttgggacactgctggtcaagaaagatttaggacaattactagcagctactaccgtggggctcatggcataataattgtttatgatgtgacagaccaagaaagcttcaataacgttaggcaatggctgagtgaaattgatcgctatgctagtgataatgttaacaaaatactggttggaaacaagtgtgatcttacagcgaataaagttgtgtcatacgaaacaggcaaggcacttgcagatgaaagtggcataccttttatggaaactagtgcaaaa

SEQ ID NO: 25506 - DNA, 415 bp, Gossypium hirsutum
  Clone ID: LIB3272-051-P1-K1-C2
aaaatatttagcaaaggataatataaataataattaatgtccgtttttctgaatcgtttgtctcgtctcctccgtccgcaatgcatccctaatctgagcaaaagtatttacgcgttttgcgttgcttaattccttattatccattcccttttctccttttctttccttatttatatttccttttctcactattttcctctccaattttccttctttcatttctctccaaattttcccaacaatggagtccgtcgatcttcacgaaaccaccaatgccaaccacgttgaccacggctggcaaaaggtctcttatcccaaacgtcaacgcaagaccaagcccaacgccgatcccaacctcccccgtcctaacggaaccctaactaatggctccgccagcgttttccattccctcgag

SEQ ID NO: 25507 - DNA, 417 bp, Gossypium hirsutum
  Clone ID: LIB3272-051-P1-K1-C3
ccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgctggttacaaatgtgcttaagcaatgtttgggtttttcttttacgtgttctttttttttctgggcgtgttaaatttggtgttttgatatgtcaagggttagataaaatggtta

SEQ ID NO: 25508 - DNA, 408 bp, Gossypium hirsutum
  Clone ID: LIB3272-051-P1-K1-C5
ctcacagtacgtgcctcatgtgataaagtctggaagaaatgtctttgatcgatttgctgtcttgttttcagtggtgattgtctggatttatgctcatttactcactgtgggtggagcttataatggtacagcaccaaaaacacaaacaagctgtagaactgatcgttctggtctaatagatgctgctccatggataagagttccttatccctttcaatggggagcgccatcatttgatgctggtgaagcctttgctatgatgatggcttcttttgttgcccttgtagagtccactggggcttttatttctgtgtcaagatatgcaagtgcgactccaatgccaccatctattcttagccgtggtattggttggcagggagttgcaattttggtgtcgggattgtttgg

SEQ ID NO: 25509 - DNA, 413 bp, Gossypium hirsutum
  Clone ID: LIB3272-051-P1-K1-C6
caaacgagcccagttacatatacacgtatttatcagatctaaaaaatcaaattgaattcaagaaaaattgaactcgtatatatttttgtcaatcctaatttaacgtcggtgtaagaaagggattggattctgcaatttgcagcgacttagcaaaaaaggaaaaaagaaaaaaaaaggatgcgatggtgaggctaacagggaagcagcagcatacaccgggaacgataagatttctgttgatatgcattggtatcggtcttttattgatcggtctcattgccgatattttctgggcttcatcttctcgtttcaagctttcatctctttcgatttctcattcatctgattttcccgctacatttccgttaatgttcactgagcctcttaattcgtcggcaaaccaaaaacccaag

SEQ ID NO: 25510 - DNA, 310 bp, Gossypium hirsutum
  Clone ID: LIB3272-051-P1-K1-C8
atcgggcgaaattgaaataccactacttttaacgttatattacttatgccgcgaatgggacgtggggcacggtccttatttttggacccaaggccaggttgggacgaccaatccacgtgaaatacattgcaatgtggggagagaaggatttacgacacatactatgaaaagactacccaggtgttcataagatagctaaaggagaacatgtgactgatgatggaacgcatggataacagttggcatggtttttatgaacatgaccaatacgatccgtataatgttaacaaaatactgcttgaaaccatgt

SEQ ID NO: 25511 - DNA, 409 bp, Gossypium hirsutum
  Clone ID: LIB3272-051-P1-K1-C9
gttcgtgattgaaaacacaccaatatgtaatccccataccctatccctccaccaactttgtccaatagcatagcaatagaacgagataaagttagtaagtatatagacttccaactgtgaccgaagaaactccaatggcttctcttcaatggctgctgcaactgagctccagtcccttcttgctctttgcatcaatcctccttctccttaaacttcttttcaaccaaaactccaccaaaacaaaacccaatcttccaccatgccctcccaagttacccatcatcggcaacctccaccagctaggtaccatgcctcatctgtcactccgtcgcctgtccaacaagttcggcccaataatttacttacagctgggtcagatccccaccgtggtggtttcatcagctaaatt

SEQ ID NO: 25512 - DNA, 336 bp, Gossypium hirsutum
  Clone ID: LIB3272-051-P1-K1-D1
gggacatccgataaaattggaacgatacagagaagattagcatggcccctgcgcaaggatgacacgcacaaatcgagaaatggtccaaatttttgtaactcattttcatttctctcaatttttatatctggttcttgcataattaaattctgagtatgcttagctgagcttatgctttggggtcactgtggttcttgctgggcttttggagctgttgaatcactatctgatcgggtctgtatccattttgacatgaacatatctctgtctgttaatgatcttcttgcatgctggggctttctatgtggagatcgttgtgatggagggtattcaatc

SEQ ID NO: 25513 - DNA, 408 bp, Gossypium hirsutum
  Clone ID: LIB3272-051-P1-K1-D10
gtgaaatcgaaggaaaccatctctctgccgccgctatcatcggccaggacggcagcgtttgggcccaaagcgccagtttccctcagctcaagcctgaagaaattagtgccatcatgaatgactttaatgaaccgggttcactcgctccgaccgggttgcacctcggtggcacaaaatacatggtgatccaaggcgaaccgggagctgttatccgagggaagaagggacccggaggtgttactgttaagaagaccaatatggccttgattatcggaatctatgatgaaccaatgacacccggccaatgcaacatgatcgtcgagaggctcggcgattatcttctcgaacagggtttatgattctcttcagtgtgtgtccttatttgaatgcatttcttctcgggtcttt

SEQ ID NO: 25514 - DNA, 400 bp, Gossypium hirsutum
  Clone ID: LIB3272-051-P1-K1-D11
gcaaaaatgagggattccccatcatgttttggtgaaaatggggttcaagtagctgattcatcatcatcaaacacaagtaaaaatggacaaaacatagttctttgtgtttatcaatgtcaaatcttaggtagatcgtgtttaataactgtgacttggaacaagagtttaatgggacaaggcttaagtgttggtattgatgattctacaaatcaatgtctttgtaaagttgatataaagccatggttattctctaaaagaaaagggtctaagtctttagaagcatatttttgtaaattagacatattttgggacctttcgacggcgaaattcagttccggaccggaaccatcgcaagggttttatgtttgtgttgttgctaataaacaaatggtattgcttc

SEQ ID NO: 25515 - DNA, 399 bp, Gossypium hirsutum
  Clone ID: LIB3272-051-P1-K1-D12
aaaaacaaaattaatatattttccgttacagtctcgaaaatcggtcaaaattctcgtcagaagcatttatgaccgtcggatcaagctcgtgatctgtgacgacgacattattttttctactggttttttttcaaggtgcgcgcggctaaaattttccctgttgttgaaattgtggatctgaaaatcagatcattggcggcggatccttgattcttcgtgtggaagcgtagatgtcggggccactcgatcgattcgctagaccttgctttgaggggttttcaggtagtgatgagagaagagagaggaaatctgattttgagaactccgaggatgaaagacgcactaaaattggatcattgaagaagaaagcaataaatgcatctactagatttaagcatt

SEQ ID NO: 25516 - DNA, 102 bp, Gossypium hirsutum
  Clone ID: LIB3272-051-P1-K1-D4
gttgcaatatcatactcgatagcagtgttaattttctcatcccatgatcagtaccgatactaggcatttgaggcatcacgtatcaaaacatttcatcttcct

SEQ ID NO: 25517 - DNA, 207 bp, Gossypium hirsutum
  Clone ID: LIB3272-051-P1-K1-D5
gttattttagttttttgttccctttttaatgttcttcttttactgttaatttccatcgcttgtaagcagtgattgttagcatgcatacaaggtgtttagcaccttgtcgggtagaagggatgagaaccgaatccatccttttctgtaaatccgggattttatgccctctccatgcttcttttaagccgactttattagttttttttc

SEQ ID NO: 25518 - DNA, 409 bp, Gossypium hirsutum
  unsure (1)..(409): unsure at all n locations
  Clone ID: LIB3272-051-P1-K1-D6
ttcattagtaattgaaccaaagaaaagacatgggagtttcaggcacttaggagtatttgtctgatttaatgagcagtagtggtcataagcacaagaagagaaaacaattgcagacagtagagctgaaggtgaggatggactgtgatggttgtgaactcaaggtcaagaaagccctctcttcattgaatggagtgaaatcggtgaacataaacaggaaacagcagaaggtgactgtaacgggatatgttgaagctaacaaagtgttgaagaaagctaagtcaacagggaaaaaggctgagatttggccttatgttccttacaatctggtggctcaaccttacgctgttactgcttatgacaagaaggcacctnctggttatgttaggaaagtagacaacaatgtaagcag

SEQ ID NO: 25519 - DNA, 412 bp, Gossypium hirsutum
  unsure (1)..(412): unsure at all n locations
  Clone ID: LIB3272-051-P1-K1-D7
gtttcttttctttttttttttctcgagaaccaaacacgcacctttagtaaccagttacttttggctttggcttttaatttttattaatactaaaaaggagtgctggaggctcttcttttttctttttttttccattgacattcttgataagtagggaagaccatgtgaattgtttgaactggactacgattatcgactttcttgacggggtaaacgtatcggttattctcagnnttggtacaaaatggtcaaatgcaaaggttgtgggaaattaggaaggatgctaccgggtgacgggcctgcaaaagcttaccattatgctcttctttgttcccctgttgattctgtttgggattgcattgcccgtaagaagagatactcctacatacctgaatgggtgtagtctttggtg

SEQ ID NO: 25520 - DNA, 394 bp, Gossypium hirsutum
  unsure (1)..(394): unsure at all n locations
  Clone ID: LIB3272-051-P1-K1-D8
accaccaccagcgccaccaattgcgaaaagccgagtcgaagaagcggaagccgagcgctcgcaagctggcttacagtccgaagcgagccatggttgagctgaggcactcgggcagctcgctcgggagccgagcctcttcttctccgatgaaacgcgacgaggatgcttcccctctcatcttcaacgatcacgtccttcgagatgatgatgacgatcatcctcgccattcatttcgagatcgttaccgttcgttttggtcacaaatttactcgtttttccctttccttaatgatgatcctaggttttctcaacacggttccaggatctcgcttctcttgctccttttcatcgccgntgctggattgattttctttttctcgatcttacaacgatt

SEQ ID NO: 25521 - DNA, 411 bp, Gossypium hirsutum
  Clone ID: LIB3272-051-P1-K1-D9
gttggtgatgaaatccattgttccagttgttatggctggtgttttgggtatttatgggttgattattgctgttattattagtactggcatcaatccaaaggccaaatcgtattatctttttgatggctatgctcatctttcctctggtcttgcttgtggacttgctgggctttcagctggaatggcaattggaattgttggtgatgctggtgtcagagctaatgcacagcagccaaaactttttgttggaatgatcctgatcctcatctttgctgaagctttggctctttacggccttatcgtgggcatcatcttgtcttctcgggctggccaatctagagcagagtaaggcgctggtagagctgttttagtagtattcttttattgcttatcgcgtttattatgattgga

SEQ ID NO: 25522 - DNA, 389 bp, Gossypium hirsutum
  Clone ID: LIB3272-051-P1-K1-E1
cggacgcgtgggctctcaccatgtcattgctgtctttctcctttttgttgctgtttacttttagtgccaaagctattgttcctccatctgaaacttttaggtttgtcaacgacggagaatttgggccgtatgttgttgaatatggtgcaaattaccgtgtcataagcatagctaatgcccccttccagcttgcgttttataacaccacctctaatgccttcacccttgcgttacgcatggctacaacgcgttccgagtcgctcttccgatgggtttgggaggccaacagggggaaccccgttcgcgagaatgccacgttctctctcgggactgacgggaaccttgtcttggctgatgccgatggtcggattgcttggcaaagtaacact

SEQ ID NO: 25523 - DNA, 271 bp, Gossypium hirsutum
  Clone ID: LIB3272-051-P1-K1-E10
gcttcactgagctctctctctctctctctctctctctctctctctctcccatttccctccatggccgtctcttttaaaatgtgcgcgagtttcggtctatttgtgggtcttatgatgctgggtctggtaagctcagctaagttcgatgagcttttccaacctggttgggctatggatcatttcatctatgaaggagagctccttagctcaaactcgacaactatttcggtgctggctttgcatcaaaaaagcaagttctatttggaaaagt

SEQ ID NO: 25524 - DNA, 389 bp, Gossypium hirsutum
  Clone ID: LIB3272-051-P1-K1-E11
tagggtttgcacgagccgtagtgcgccgttcgcatcaggaagaaatggcggtccctttgctgtctaagaagattgtgaagaagcgtgtcaagaagttcaagaggccccaaagtgaccgcaagatctccgtcaagacaaactggcgaaggcctaaaggtattgactcccgtgttaggaggaagttcaagggatgcactttgatgcccaatattggttatgggtccgacaagaagactcgccactatcttcccaatgggtttaagaaatttgtcgtgcataacgtccaagagctggagcttctcatgatgcacaacaggacatactgtgctgagatagctcatgatgtttcaacaaagaagaggaaggaaattgtcgagcgggcagcacag

SEQ ID NO: 25525 - DNA, 417 bp, Gossypium hirsutum
  Clone ID: LIB3272-051-P1-K1-E2
gtcaccttgcaaaacccagattaccataacagatgcaaaatctgatcggtgaacataagaaaatggagaccatgggaaaacttctaatcctgcttacagcttttttatgcctctacctcttcgttgctttgctcaatgttttctacaagtattggtggatacctcaacgggtacagttcatcatgaattcacaaggaatcagaggacctccttatgaatttatccatggaaacaacaaagaagctgcccaaatgctcatggaagcatctaccaaacctatgggcttgacacacgatatatttcccagagtcgtgcctcatgtttactcctggatcaacaaatacgggagcacttttcttagttggaatggaattcgagctcaacttgcaattacagacccagatctggtcaaagagg

SEQ ID NO: 25526 - DNA, 303 bp, Gossypium hirsutum
  Clone ID: LIB3272-051-P1-K1-E3
gtctgctcgaaaccttcttcattctcatccgctctccattgaactggagctaaacggcgtctgtttagagagactgtcatgaatggcgaacgagccagatctggtactgggggctggagctgtaagacacatagggtatgctattggacccaggacagctaggggagtcatgtagcgtgctgaccagtcggggtttctcaacatgctagggataggatctgctgctgaagcttgaggatggagtaaaatggagtggagggatgcatgcatggccgcacctaaagaatgtgcttataagcaagt

SEQ ID NO: 25527 - DNA, 406 bp, Gossypium hirsutum
  Clone ID: LIB3272-051-P1-K1-E4
ccggagtgccagccgtggtcgaccttgcttgtatgcgtgatgctatgcacaagcttggcagtgatacaagcaagattaatcctctggttcctgtagatcttgttatcgatcattcggttcaagttgatgtaacaagatcagaaaatgctgtgcaagcaaatatggagcttgagtttcagcgaaacaaggaaagattttcattccttaaatggggatcttctgccttccgtaacatgcttgttgttcctcctggttctggtatcgtgcatcaggttaatcttgaatatcttggtcggcttgtgttcaacaccgatggcattctctaccctgatagtgtggttggaactgattctcatacaaccatgatagatgggctcggagtagctggctggggagtaggaggtat

SEQ ID NO: 25528 - DNA, 343 bp, Gossypium hirsutum
  Clone ID: LIB3272-051-P1-K1-E5
atttcattcatatgcctttcttttctcttcgcggaagttcatgctgaggattccacaaagacagcgtactaactcccaactcatgtgactaaattctagttttgtttaggcggttatggcttggtttactgctttcttcacccgtgttaagttgtgtatgttattactataatttgtcgaccagacaaaatgactgttgtttcaagttttgtagtctgaccaagattttttaagaatggcaatataagaagagaaaaacaatgatttctatactgacttgcggttgcatgaagaatgcactcaaacagagctcatgactgcttatataaacttgacctgagat

SEQ ID NO: 25529 - DNA, 409 bp, Gossypium hirsutum
  Clone ID: LIB3272-051-P1-K1-E6
gatggtttttctttgtttcgagtgttaaaaattttgcagacgatgtcaaacttaatactttttgaggatatttttgttgttgataagcttgacccagatgggaaaaagtttgataaagttacccgcattgaagcacggagccagaactgtgatatgttcatgcacctcgatgtaaatacagagatatatcctatgcatgttggtgataaattcacaatggcgttagctcacacgttgaatttggatgggacgcctgatactggctatttcaatccggggaggaagtctcttgcagataagtatgagtatgtcatgcatgggaagttatacaagatatcagatgattcttcagggaaaggacttaaagcggagatctatgtatcatatggtgggcttttaatgctattga

SEQ ID NO: 25530 - DNA, 148 bp, Gossypium hirsutum
  Clone ID: LIB3272-051-P1-K1-E7
gcaaatggttctattttggctgatgatgtgtttggatactccattctccattcctatgattttgtctgcaagtcaggcctgtccgctgtatgagatttaagactacctttgaacttcaaatttcaaaccatctccccttttcgctttg

SEQ ID NO: 25531 - DNA, 414 bp, Gossypium hirsutum
  Clone ID: LIB3272-051-P1-K1-E9
ccaaaatctcatctttccattagagcgcagctctcattcctctcgattttctttcactttgttcgcctcttcgattatcaattccgctctcagattcttgaagcaagcgaagttcaattctccaccctacatcagaagaaaactctgattccccaaaattagggtaatctcaatccctaaaagatgccggccaccgcagggagggttcgaatgcccgcgaacaaccgggtgcatagtagcgccgccttgcaaacccacgggatttggcaaagtgcaatcgggtatgacccttatgctcctaataaagatgattcaaaaaattcatcgagtcagatgactgccgctgctgaacccgatggtgaaaacgcatacgctagctttcaagggcttctagcccttgcccggatcacgggt

SEQ ID NO: 25532 - DNA, 415 bp, Gossypium hirsutum
  Clone ID: LIB3272-051-P1-K1-F1
ataaattttacaccttccataaataaaatttaataaatttcacatatatatcacaagacaacgtcttctaagaagcagccatcttcaacagaagctgaatatagaactgtggcttgtactgtttctgaattgatatggattgaataattgttagttgagcttggaattgagttcagtactttggtgtgaaaacacaagtgctgttgccatgtccagtaatcctgttttgcatggtcgatccgaacatgtggagcttaactaacattttgtaagagatcatgtagccgatgggaagcttgagatcaactatgtaccagcaaaggagccaattgcagtctgtttaagtgtgtttgtaactaaacagcagttgtaactaagtttgttaacctcagccttctatgcattatgctcattg

SEQ ID NO: 25533 - DNA, 377 bp, Gossypium hirsutum
  Clone ID: LIB3272-051-P1-K1-F10
caaaaagcttcaaatctcctctgcctattggagattacagcaaaaggcttttctgtttttgtttttgttttattttttatttatttataattttacaagtgtaaaaatccccttggggaatgcagagagatgagacgttcatcgttggcaaggcctgagctttcttaccaccgtaagcgctccattggcggccgaaattgtcaccgaaaacacgtcgaagacgggtgattcagtttgaagggtttcagttttaaatatacatatatttctcacttctattgtaaatagacagtaattcagatcaaagggtatccagttcttttcttatttttcgttttaatttctcgagcttttacggttcaaaaatggcggacaaa

SEQ ID NO: 25534 - DNA, 410 bp, Gossypium hirsutum
  Clone ID: LIB3272-051-P1-K1-F11
cgagctgtgaagtgcagaatcaagggattgtgggtggagaagaagcggtgacggatctaacttggaactccgttttctcttcttaccgctattcccgacctatctctaaccccctcaatttctctcaggtagatattccttgtgttcaagcgtcttcatggcttcaaagcggattttgaaagaacttaaggatttgcagaaggatccaccaacttcctgtagtgcaggtcctgtagcggaagacatgtttcattggcaagcaacaattatgggcccctccgatagcccttttgcaggaggtgtgtttttggttaatattcattttcctccggattatccattcaagcctcctaaggttgcatttaggaccaaggtcttccatccaaacatcaacagcaatgggagcattt

SEQ ID NO: 25535 - DNA, 319 bp, Gossypium hirsutum
  Clone ID: LIB3272-051-P1-K1-F12
cacttatccctattgttgatcaatctgtggtggagaagacaattcggccatgcctagttgaactaagtgaggatccagatgttgatgtcaggtatttcgccacccaagctctacaatcaagtgatcagcaaatgatgatgtctagctagaaccctacattacttgtatcacacttctacatcctttcctttttcctttttaaatttattttaccttaaagcttttgttttgtttttttccttattttaattgtatatctttttttcagattgaaacactcctttgctatatatgtaatttttctaaaattgaattgttg

SEQ ID NO: 25536 - DNA, 397 bp, Gossypium hirsutum
  Clone ID: LIB3272-051-P1-K1-F2
agtaaatcaagccgtgcacgtacctacatggctgatggttaaccagcggatatccattgtggcactggtgctatatctggatactttagtgaggaccatgatacagatggtgatcttaccgtttaacatatggaatacattgaagcaacaaacgagtgcagcttaacattcttgattgccaagtttgatggtatactacgacttggatttaaagagatttcatttagaaatgctcgacctgtatcgtacaacatgacaaatcaaggtcttgctaatgaaccaagtctttgattctaacttacaccgcattctaatgataatgtacgcctataagtgagaattcggggtatggatacaaaacatcacaggggggaacacacttatgttcctgtgacac

SEQ ID NO: 25537 - DNA, 394 bp, Gossypium hirsutum
  Clone ID: LIB3272-051-P1-K1-F3
ctctctatattttctcatctccttttccaccgccgtcgatctcgatccttatccccgttttcaaaaaagctccaaaaagatggccaatgctgcatcgggaatggctgtgcatgatgattgcaagttgaagttcttggaacttaaggcaaaaagaacccaccgctttattgttttcaaaatcgaggagaagcagaagcaagttattgtggagaagcttggtgagccaaccgagagctatgaggattttactaaatgtcttcccgctgatgaatgtcgttatgctgtgtacgattttgattttctaacggccgagaacgtcccaaagagcagaatctttttcattgcatggtctcccgatacatcaaggatcaggagcaaaatgatatacgctagc

SEQ ID NO: 25538 - DNA, 395 bp, Gossypium hirsutum
  unsure (1)..(395): unsure at all n locations
  Clone ID: LIB3272-051-P1-K1-F4
ctcaacctccattttgcccattccactgctcgatctccttacagctaccgtacacactcacacacacattcactgaatgggtcgagtcatccgagctcaacgtaagggtgctggttccgtcttcaaggcccacacccaccaccgcaagggtcctgctcgtttccgcagcctcgacttcggtgaacgaaatggctacctcaagggtgttgtcaccgatgtcatccacgaccctggtcgtggcgctcctttagcccgtgttgtcttccgtcaccctttccgttacaagaagcagaaggaacttttcgttgccgcagagggtatgtacactggacaggtcgtctattgtggtaagaaggctactctngtggtcggaaatgtattgcctcttagatcta

SEQ ID NO: 25539 - DNA, 413 bp, Gossypium hirsutum
  Clone ID: LIB3272-051-P1-K1-F5
aactaacccgtgtcaaaatcacagataccatcacaataacaaatttttttcaataggaaaaacatttgcaaaaataagaaaacctcactcccagccagtgggagcaggagcagatacatcgattccagggccagggatttgtggtggagcacttgcaggatcccaaacatcagcgctaacagcaacttgatcaccccagttaattgcagggacacccgaaattggtggctgaaccacatcagctgaccactgatcacccatttgggagggccattggtcagttcctaaagcactcattccaaaatctgcagcagggagtccataatcaggagcagcaactgcttcctcctcttcctgttgtttagcttcctcaggctccctgtagaaaaatagatccaccatcacatcccact

SEQ ID NO: 25540 - DNA, 411 bp, Gossypium hirsutum
  Clone ID: LIB3272-051-P1-K1-F6
tattgagagagagtgagaaagatgggagagacagacaaagacagggaacaggctgagcatggatggatctaccaactgattctgttgtttctccgcccatgcactgcctcttccctggctctgcctcctccatttttttcctccctctttttttatttaactttttcaccttatcccattttggaattattattatgactgtaatttagatccaggttcatgataggtaccttttaacaaggtaattgtggtgacttttgttgagccccaatggccccagctcttttttcttcattttctctctattcttttcaatccaagtatagagattattcgttttactggtaatggaaatttgcattttgattctccaaccatttccaggaaccttattgttttttccactatcac

SEQ ID NO: 25541 - DNA, 411 bp, Gossypium hirsutum
  Clone ID: LIB3272-051-P1-K1-F7
gaaaatccaaatgggttttaggaatattattggcagaaggcttggccttggccttgtaaggaggaggaaacctttttcgactgctacttgcgatggcgatggcaatggcaacgccaaatccatcaacctttactccgctatcaatcaagcccttcatattgcgcttgaaactgataatcgcgcatttgttttcggagaagatgttagctttggcggggttttccgttgcactaccggactcgctgaccgatttggtaaagctagggttttcaatacccctctctgtgaacagggcattgtcggatttggaattggcctagccgcaatgggaaatcgggccatagcggaaattcagtttgcagattacatataccctgcttttgatcagattgtaaatgaagctgccaagtt

SEQ ID NO: 25542 - DNA, 409 bp, Gossypium hirsutum
  Clone ID: LIB3272-051-P1-K1-F8
gcagcctgcagcctgcagctgttctcacaagtagtattagttgttatttctgtcattgttagtggagctgtgttaaataagtgaagtatacacaatcttgcatggagtttttcatatataatttggagcccttccaaaaatagaagagcgtagacaaagaacatgaatccttcccaatgatattagttggaaaccagtagcataaggggtcgaaatctcatctctatttcctaaaggaagcaaaggatacatgagtgtatactatgtcccaataaaggaaggtgaaccatcattagtcaacatcttgggttgtagagaaagtgaaactcacagctaggcatgagggatgatgggttggatgtgtgaatgagaagactggttattccaagagggacgcggcctcataaaa

SEQ ID NO: 25543 - DNA, 410 bp, Gossypium hirsutum
  Clone ID: LIB3272-051-P1-K1-F9
ggagacgccatgattgcaaaaagtttgaaagacagatcagcagccatggatcctggaatctggagcaagctaccgcaggaacttctcgagcacatactctcctttttgcctctcaaaaccttgttgaatttgaggtcaacttgtaagcatttcaagtctctcgtattctctccatctttcatttccaagtattcttctgcttctcttttctcttcattctttttgctttctcatccccagtgctacagtaatttccctctctacgatactatctgtggggcttggcgcaaaatagcacttcccttgtcttttttaccgccttccgccgctcagtttaaccttctttcatcgtgtaatggacttttctgcttctctctccccaattcctcctctttccttgtttgcaacct

SEQ ID NO: 25544 - DNA, 413 bp, Gossypium hirsutum
  Clone ID: LIB3272-051-P1-K1-G1
aaaaaaattcaaatttcattctcttattttattttattttatttcatattttgggagagggagaacgatcagcgaaaatgaatatattcagattagcaggggacatgacccatttgtttagtgttcttgctttgcttcttaagatccacacaatcaagtcttgtgctggcatttcactgaagactcaagaactctatgctattgtctttgctactcgttacttggacatattcactaatcatatctcaccttataacacaatcatgaagctaatattcctgggcagctctttctcaattggatggtacatgcggtataacaaaatacaccgtagatcttatgataaggaccaggatacatttcgacattatatccttatactgccttgcctgattcttgcccttcttataaac

SEQ ID NO: 25545 - DNA, 404 bp, Gossypium hirsutum
  Clone ID: LIB3272-051-P1-K1-G10
cttcacctttgctcccactcctccactgactttcaccaccaccgtcactagcggcgccgtcacaaaatgtcgtcaacggagtctctcatcctccaactccatgaaatctctgccgttaaattcggtaacttcaagctgaaatctgggatcttctcccctatctacatagacctccgtctcatcgtctcttacccttccctgctccaccaaatctcccactccctcctctcctctctccctccccaaacacactttaacctcatatgcggtgtcccttacactgccctccctatagccacctccatctctctcgacacctccatccccatgctcatgcgccgcaaagaagtgaaagactacggaactgccaagtccatcgaaggtgtttacgaaaagggtcaagc

SEQ ID NO: 25546 - DNA, 412 bp, Gossypium hirsutum
  Clone ID: LIB3272-051-P1-K1-G11
gtgtctttgcagagtatcgggtagtcctttcaatcctcagccatggcggaacagacggagaaagcatttctcaaacaacccaaggtgtttttaagctctaaaaaaaatgggaaaggaaagagacctggaaagggcgggaatcgcttctggaaaagcattgggttaggctttaagacacccagagaggccattgaaggaacatatattgataagaaatgcccatttactggcactgtttctattagaggccgtatccttgccggtacttgccatagtgcaaaaatggtaaggactattatcgtccgaaggaactaccttcactacatcaagaaataccaaagatacgagaaaaggcacagcaatatcccagctcatatattcccctgctttcgtgttaaagaaggagatcatg

SEQ ID NO: 25547 - DNA, 405 bp, Gossypium hirsutum
  Clone ID: LIB3272-051-P1-K1-G12
ggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttatttttcagcttgggcgcctgaccctgttacggggtatta

SEQ ID NO: 25548 - DNA, 408 bp, Gossypium hirsutum
  unsure (1)..(408): unsure at all n locations
  Clone ID: LIB3272-051-P1-K1-G2
ggagctttcgttttaaaacgaggaatcaacatttaagtggcggctcgcggngacacagtgaatagggaaagatggaagaaggatgcgaaattttgcagctctacgaaattccgtactcggatctcttgcttctatcatcttcttccgcatcgtgttcccattatcaagagagaatgataatggaaaacctggggccgacgggccctggcctcttcgctattacaaacgttcccgacgcttcgcttctccgacgaaagctcctccctcttgctcgcaagctggctcttcttagccccgatgatcgcaaacgtattctcagagaccacaacttggggagtgatgttccattgaaaaacccagataggaatgtcttctctttcgcgatgcagctcaaatatgctcaaggta

SEQ ID NO: 25549 - DNA, 413 bp, Gossypium hirsutum
  Clone ID: LIB3272-051-P1-K1-G3
gtgagcagtcaagctaaggtttgagatttatcaatggcggagaagagtttcaagtacgtcatcctcggtggtggtgtcgctgccgggtatgccgcgagggagtttgccaagcagggagttcagcctggtgagctagccattatttccaaggaagcggttgctccatatgaacgtcctgctctgagtaaggcgtatctcttccctgagggagctgcaagacttcctggtttccatgtctgtgttggaagtggtggagagagattgcttcctgagtggtacaaggaaaaagggattcagttgatccttagcactgaaatagtgaaagcagatcttcctgccaagactgtagtaagcgcagctggagaaacattcaaatatcaaattttgatcattgcaactggttccacagttat

SEQ ID NO: 25550 - DNA, 395 bp, Gossypium hirsutum
  Clone ID: LIB3272-051-P1-K1-G4
agcagctatccatttcctttgctggagagcttcccagtcctttaaagtttcattaaataaaccaattttaatgtcgtcgtcctcgctctctaatcccgctctctccactcctttcatctgccacaaccttcgtctaaatcagaatacgaaggatgggataaattgttttccctctcttagaaggcatagagtcccaagatgtgcagtggatatgccttacggaggtaatgctccaacttttcctcaaataagagtctgggatccgtataagcggctcggcattagtccttacgcttcagaggaagaaatttggtccgcgcgcaattttctcttagaacaatatgctggacatgagagaagtgaagaatcaattgaagcagcattcgagaaactac

SEQ ID NO: 25551 - DNA, 441 bp, Gossypium hirsutum
  Clone ID: LIB3272-051-P1-K1-G5
gcccacgcccgtccggagcatagtcatacactttttacaggggtgcagcaaagacagtacagagcggcggtatagaaattggacgtcatgcatctcatacgaggcgataacaaatagtgtcgtagagagcacgcaggtgggttgcatatagccttacatcagcggtggaggggtagagccatctgctgctttcagtatgcaggtgaggcgatgacacgagagttcatgacgaacaagatcgatgtagcaaggaagctgtatatacattgcattacctgcgcgtaacaaacctattaccatttcatgggtccaaagaaggtggaatatgtacctgaatagcccaaaacttgaacccgcactatccaaaagtttcaactaagagctatggccagagcttctcaaagtactgacacaacagaagtggcttaacatcatgaaaac

SEQ ID NO: 25552 - DNA, 389 bp, Gossypium hirsutum
  Clone ID: LIB3272-051-P1-K1-G6
ctcatctccacttatttcttgttttccgccgccaagataattcgatctcagcccgcccgtaggcttaacgccatcttcctcaattccatcggtttcacgagatggcaacagagggaggcaagagctttgcaaggagagacaaactacttgaaatcgagtcaaaggttagagtttggtgggatgaaaaagatgttttcaaggctgaacctgctgaaaaaccacctcaaccaggtgaaaaattctttgggaactttccgtttccttatatgaatggttttttacatctaggtcatgccttttctctgtccaaactcgagtttgctgctgcttaccatagattaagaggtgcgaatgtgttattgccatttgcttttcactgtactggtatg

SEQ ID NO: 25553 - DNA, 409 bp, Gossypium hirsutum
  Clone ID: LIB3272-051-P1-K1-G7
gttttctctcttctcccatttgagaattcttaaggaattctatttgtttgtaatattttggagatagtaaagttatcatctggtgttagtgcccgaggacgtaggtataatttaccgaacctcgttaaaactcttgtgttcttttttgtcctatttttctttcaatatttgagggtataatagtagtatttaattgtgctattaaattactatagaagggatattctgactaaggaaagacttggtatttaagagatcattgtgatccacctctcttccctgggaattgaactttgtgtgattttttagtacaataatttacacgcttccgaccctattggaacaacaaatgagaccatggtcagtacaatcaacatttgcagatattgagaggaaaattgaaaaggta

SEQ ID NO: 25554 - DNA, 410 bp, Gossypium hirsutum
  Clone ID: LIB3272-051-P1-K1-G8
ctaaagccaagaaagcaagccattaaggttttgagaaaagatcaaaatggattcaaaaagatcagcttccacagccctccttttagccctcaacattctcttcttttccctagtcagtgctaattgtggatcttgttcttcttctggctctaacccaaggccaactcccacccctactccatctgcacgaggtaggtgccctagggatgccctcaaattaggtgtatgtgccaatgtgcttaacttagtcaatgtcaccgttggttcacccccggtgatgccatgttgttcccttctcaacggtcttgtggacctcgaagccgctgcttgcctttgcaccgctatcagagctaacatcttaggcatcaaccttaacatcccagtttcccttagcttgcttctcaacgttt

SEQ ID NO: 25555 - DNA, 413 bp, Gossypium hirsutum
  Clone ID: LIB3272-051-P1-K1-G9
caacatccaaaaggagtccaccctccacctagtccttcgtataaggggtggcatgcagatatttgtgaaaacccttactggcaagaccatcaccctcgagttggaaagttctgatacgattgataatgtcaaggccaagatccaagacaaggaagggatccctacagaccaacagaggcttatttttgcaggtaaacagcttgaagatggccgaactcttgcggattacaacatacagaaagagtctaccctacaccttgtccttcgtacttaggggtgggatgcagatctttgttaaaacccttactggtaagaccatcacccttgaggtggagagctacgatactatcgataatgtcaaggccaatatccaagacaaggaagggattccaccagatcagcagaagttgatt

SEQ ID NO: 25556 - DNA, 410 bp, Gossypium hirsutum
  Clone ID: LIB3272-051-P1-K1-H1
cggacgcgagggtttttctacatatcaggagcagggcaactaactggtttagggtaaggggatagcatagctttagagataaccaaacactgcaccgattgacacatcatccactggctgtacttacaaacccatcacgccaccgaagatggaaacgtctgtgaatcttcaaggatcaaatgttttcagccctgccctgattgttacgctgattacacgacttgctcagaacgaaagcgtgccatgactgtctctagggacaacatgatctatccggagaggcactgtactcaacaggaagagaagatgcattgctttgccccggcacctaaatgatacctcaccggcgtttacttggcctacgagtcgggactatgagatttatgctaatgctccctataaggccttga

SEQ ID NO: 25557 - DNA, 415 bp, Gossypium hirsutum
  Clone ID: LIB3272-051-P1-K1-H10
acttgagagtcaatttgctggcttcttccctctccttggagcttcaaaggggaaactgcagggattttctttttcattctttcttttttggtttttgaaagcagagaaaatttgaatcgcttcaatgtcgtccgtactcaacactgtatcatccttgaggctatccagagtttacaatagcaacaacaacaatcacctgcgactcccaattcactccgttttaactcctccttctgtctccttcaccagacggagattgactatcagagcggcggacactgatactaatgaagtaaaatccaaggcaccggataaggcacccgccggcggtggttctagcttcaaccaacttcttggtatcaaaggagctgctcaagaaactgataaatggaagattcgtcttcaacttacaaag

SEQ ID NO: 25558 - DNA, 251 bp, Gossypium hirsutum
  Clone ID: LIB3272-051-P1-K1-H11
ggcacttgcacatgggtttgtccatcctcatagacgggggacgcccgtccgacagcgcgttcagcgcgagctttgaaagggaatctggttaaaattcctgaaccgggacgcggcagctgacggaaacgttagggagtccagacacttcttgagacgcctcgggaagagttatcttttctgtttaacggactaatcaccctggaaacggatcaatctgaggtagggatcatctgtcggaagagcaccgcacg

SEQ ID NO: 25559 - DNA, 369 bp, Gossypium hirsutum
  unsure (1)..(369): unsure at all n locations
  Clone ID: LIB3272-051-P1-K1-H12
gnagcccacccgtccggaaaatatctcaaatctcctactcctcctcggaaatcttagtatcatcaccatggcctcaaatcccaaggtcttctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcaccgccggaaacggtaccggaggtgaattcatctacggatccaagttcgctgacgagaacttcatcaagaaacacac

SEQ ID NO: 25560 - DNA, 398 bp, Gossypium hirsutum
  Clone ID: LIB3272-051-P1-K1-H2
aagcaccgtgggaactaggtgatcctaaacgtcttaaccgtgggctgtgcagacaccgatagaagaatcgtgctagaagcgctaattataacagctgctgcgtgggcatctctaactgtctacactagctgggcataaaataaaggcgcggactccaactatatgagaccgattcagtgctaccagcttattaccctcatcataacgggtctaattcagatgtttattccgataaggcaaacatgtaccgctatatattgcggaattagagcgaaggttggctgtccatacatagtatataacaccggcaacctagaaagacaacctcacatattaggatgacagtatggccttcgccactctgtattaggacatcctgaatttgaacatttacattt

SEQ ID NO: 25561 - DNA, 414 bp, Gossypium hirsutum
  Clone ID: LIB3272-051-P1-K1-H3
accaaaaagaaaaaaaagaaaaaaaacagaaaatggcggtggcgggtctttacagaagagttcttccctctcctcctgccatcgagttttcttctcccgaaggcaagcaattgttcacggaagctttagcgggaggaacggcggaagggtttttcaaactaatatcatactaccaaacgcaatcggagcctgcgtattgcggactcgccactctcgccatggtcttaaacgccctcgctatcgatcctggtagaacctggaaaggaccttggagatggtttgatgattcaatgttagattgttgcgagccactggagaaaatcaaaagtcaaggcatcacttttgggaaagttgcttgtttggctgtttgcaatggtgctcaagttgaacctttcaggaccgatcaatctagca

SEQ ID NO: 25562 - DNA, 412 bp, Gossypium hirsutum
  Clone ID: LIB3272-051-P1-K1-H4
cttaagggttaaagctagcaagagcagcgctgcggcatttcttccttagaagacccggcaaacagaaatgaagttcaacattgcaaattccactactggttgccaaaaaaagctggaaattgatgatgaccagaaacttcgtgccttttttgacaagaggatctcacaggaagtcagtggtgatgccctcggtgaggagtttaagggctatgtattcaagatcatgggaggctgtgataaacaagggtttccaatgaagcaaggagttctcactcctggacgtggtcgacttttgcttcacagaggtactccctgcttaacggggtattgtaggagaaattgagagcgcaagaggaagtcagttcgaggatgcattgttagtcaggatcttttacgtttgaacttggttatt

SEQ ID NO: 25563 - DNA, 422 bp, Gossypium hirsutum
  Clone ID: LIB3272-051-P1-K1-H5
cgcaaatccccgcccaactctccgccgccgccaccgccacggcaaccgccaccgccacagatccaagcaatgggccgcgtccgtaccaaaacagtgaagaaatcctcccgtcaggtcatcgagcgctactactctcgcatgaccctagatttccacactaacaagaagatcatcgaagaagttgccattatcccatccaagaggctccgcaacaagatcgccggcttctcgacccatttgatgaaacggatccagaggggtccggttcgcggcatttccttgaagctccaagaggaagagcgtgagcgccgcatggatttcgtccccgatgaatcggccatcaaggtcgaccaaatcgaagttgataaggaaactcttgatatgctttcggttcttgggatgtctgatattccggggcttgg

SEQ ID NO: 25564 - DNA, 410 bp, Gossypium hirsutum
  Clone ID: LIB3272-051-P1-K1-H7
aaagcagctgatttatacgtttcctgaagatgctgcaaccagtactggggctccgttctggtctgccccaaaaagattccctcagccatttcagttctcagtagctgatccaagtcatctgcaatttgttatggctgcttctatcctgagggctgaaacatttggcattcctattcctgattggattgagcatccgaagatgttggctgaggctattgagaaactaatagtcccagactttgagccgaagaaagatgtaaaaattgtaacggatgagaaggctactacactctctgttgcatctatagatgatgcagcagttatcgatgaactcatcttcaagttagagctttgcacgaaaaatttgccactagggttcaagatgaaacctattcagtttgagaaggatg

SEQ ID NO: 25565 - DNA, 407 bp, Gossypium hirsutum
  Clone ID: LIB3272-051-P1-K1-H8
aattcttctttgtttgccacagagtattgagaaaaatcgctttgctgcacttccttatttgctaatatgacgctgattacagatctcgttaaccttaatctctccgactgcactgacaaaatcattgctgaatacatatggatcggtggatctgggacggacctcataagcaaagcaaggacacttgctggtcctgtaagtgacccttcaaagctacccaaatggaattatgacagtctcagcacaggtcaagcccgtggtgaagatagcgaagtcatcctatatcctcaagctatcttcaaagacccattcaggaggggaaacaatattcttgatatgtgcgatgcttacacaccagctggtgagcccatccgcacaaacaagagatgcaacgctgccaagatatt

SEQ ID NO: 25566 - DNA, 410 bp, Gossypium hirsutum
  Clone ID: LIB3272-051-P1-K1-H9
gcagctgcaccacaactacagagaagagagtaaaggggaaaaaaagcgtcgtcgtttttgcttcttcttctacttcgctctctctccttctccgaagttcctctttcgttctttcatttattcagtattgtaaaagatggccgacggtgaggatattcaacccctcgtctgtgataatggaactggaatggtgaaggctggttttgctggtgatgatgctccaagggcagtttttcccagtattgttggtcgtccccggcacactggtgttatggttgggatgggtcagaaggatgcctatgtaggagatgaagcacaatctaaaagaggtatccttactttgaaatatcctattgagcatggtattgtgagcaactgggatgatatggaaaagatctggcatcatacat

SEQ ID NO: 25567 - DNA, 239 bp, Gossypium hirsutum
  Clone ID: LIB3272-052-P1-K1-A1
caggccacttataatgggctagaacacccttgattgccaacatacacacttacttgatctcttcaggcaatccaagggatatgtgacttgcatatgctcatatcacattcgcttcacctgttcaatgggatcatggacagggatcccacaccctatacgatgcatagatgcttgtattatactcggctctcgtgaaagcgaggcaggtaatggtccaagctaaggtgtacaaaagggga

SEQ ID NO: 25568 - DNA, 385 bp, Gossypium hirsutum
  Clone ID: LIB3272-052-P1-K1-A10
caactccacctgctaaaatgcaccaatttccggtgcttctcagcctcatcgcagtggctgtactgctgatggtaactccagccattggataccggccatggcctcacttaaaacccaacagctccgatttaacgtttggaagctccaaaaaatgcgagggctcataagagatcgtccaaatgagataccatatgggaccagttttcaccgtcaacatcaccgttcacatagtttggtacgggcgatggcaaaaatctcagaagatgatcatccgtgaggacatcaactcaatctgcgacgttgatgcacaagcgcccttctgttgccggctggcggaagaccctacaactttatacggaccaaacgggcgccaacattttccata

SEQ ID NO: 25569 - DNA, 405 bp, Gossypium hirsutum
  Clone ID: LIB3272-052-P1-K1-A11
attttggtctcccaagtttcaccaaaagaaaccccgtttcacattcaaagcctttgatgcactgataggaaggcaacatcacgttaacctctttattcatgtcagaccaatgcgatttatcgctatgtctatcaaaaccaacgcacatatatacgaataagtgtatgtgaggcaaaagcgtgagagggagattaaattgtatgcattgcgtatatttggttttcaatttggttggttggttgatgggttctacttctcttcaagtttgcatggattcatctgattggcttcagggaatgactcaggaggtgccaggaatggattcttcatccccatgtggggatattctcacatgctcaaggccattgatagaaaggaggctaagacctccgcaggaacaagctg

SEQ ID NO: 25570 - DNA, 400 bp, Gossypium hirsutum
  unsure (1)..(400): unsure at all n locations
  Clone ID: LIB3272-052-P1-K1-A12
gagatgaggaaaatcatgggtgccaaagttctcttcttctttgctttgctttccttttcagctgtgtcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaagagcttgtctgagaaggaaacagacaggagctntggcctaaggaatntcaggtacattgagaccatcaaagaagctgtagaaagggaatgtcctggagtttgttcttgtgctgatatccttgttc

SEQ ID NO: 25571 - DNA, 403 bp, Gossypium hirsutum
  Clone ID: LIB3272-052-P1-K1-A2
gcgttatatctgtgaattgaaaatggatgatgatactcttaccaaagcaattatcgggaccattggtgatgttgatgcataccagctgccagatgctaaaggctatagcagtttggtacgatatttattggggattactgaggaagaaaggcaaaggagacgcgaagagatattatcaacgagcttaaaggatgtcaaggaatttgctgacgccattgatgccgttaaagacaacggagttgccgttgcggtggcatcgccggacgatgtagaaactgctaacaaggagcgcctgaactttttccaagtgaagaaagccctataaatatacacgtaagaatggcttggatcctaaatcgatctcaataccatttcttaaattaagggaacgatacttgaaaaa

SEQ ID NO: 25572 - DNA, 390 bp, Gossypium hirsutum
  Clone ID: LIB3272-052-P1-K1-A3
ctcgtgtccatcgcgtggctttcctatcttcatttcttcacactctccgacgaaagaaaccagagaaaaatgaccaagtgttacccaaccgttagcgaggagtaccaaaacgccgttcaaaaggctaagaggaagctaagaggtctcatcgctgagaagaactgtgctacactcatgctccgtctagcgtggcactcagctggaacttttgatgtcaagaccaagaccggaggtccattcggaaccatgaagcaacctgctgagctcgctcatgctgataacaacggtctcgatattgcagtcaggcttctcgagccgatcaaggagcagttccctatcctttcatacgctgacttctatcagcttgctggtgttgttgctgttgagatc

SEQ ID NO: 25573 - DNA, 405 bp, Gossypium hirsutum
  unsure (1)..(405): unsure at all n locations
  Clone ID: LIB3272-052-P1-K1-A4
gccgttttgttctcttaaattccaacaccaaaagggaaaaaatctgaaaaattacaactcgttcttgttgacctcggttcacccgccctttttttggttgtctcgaatcggtctcgagtntttggaactcagttcgtgacttggatctggtaaggcttttaaggtaaatcagaaactgtatcagaatgaaggcacttattcttgatggagggtttggaactcgattgaggccattgactctcagtgttccgaagccacttgtcgaattcgctaataaacccatgatcctgcatcagattgaggctctcaaggctgttggtgtaactgaagttgtgttggctattaattaccaacctgaggtgatgctgatacttttgaaggagttcgaaactaaactcgggatca

SEQ ID NO: 25574 - DNA, 342 bp, Gossypium hirsutum
  Clone ID: LIB3272-052-P1-K1-A5
aatttgttatccatggcttccgaaacttgttccccttctaacaagttgagattcctcctaggaatggttttatttcttcttatgaatatgaccactgaacagttgtcctctaccttttattcaacaacatgccctaaagcacttgccaccattaaatcagcagtcaactctgctgtgtccaatgaagctcgcatgggggcttctttgcttcgtcttcatttccacgactgctttgtcaatggatgcgatggatccatactgttggatgatacagcaaatatgacaggagaaaaaacagctgttccaaacagcaattcaatcaggggatttgaagttattgat

SEQ ID NO: 25575 - DNA, 362 bp, Gossypium hirsutum
  Clone ID: LIB3272-052-P1-K1-A6
ctttttcttccttcttatttacagcttcctccctttatctgacaggccatttccctttctgatatccttccctccctcactctctcttcttctgcctttgatctgctctctatccctttctctatagtatttagtggcatatttagaaaaagtgttagtgaagataaagcgtgagagggagattaaattttttgcattgcgtatatttggttttcagtttgtttgtttgtttgatgggttttacttctcttcaagtttgcatggattcatctgattggcttcagggaatgactcaggaggtgccaggaatggattcttcatccccatgtggggatattctcacatgctcaaggccattgata

SEQ ID NO: 25576 - DNA, 400 bp, Gossypium hirsutum
  Clone ID: LIB3272-052-P1-K1-A7
ttatagctctctcctgattagaatttgtacaataaaaagaagcttttttgttttttgttaacattttcagatccaattcattactctcttcaaaggaccaaaaagaagatggcttcaacattcagcggcgatgaaactgctcctttcttcggcttcttgggtgctgctgctgccctcgttttctcttgtatgggagcagcttatggtacagcgaaaagtggtgttggtgtagcatcaatgggtgtaatgagaccggagctggtgatgaaatcgatcgtcccggtggtaatggctggtgtgctgggtatttatggtttaatcatcgctgttataatcagtactgggattaacccaaaggctaaatcttattaccttttcgatgggtatgctcatttatctt

SEQ ID NO: 25577 - DNA, 400 bp, Gossypium hirsutum
  Clone ID: LIB3272-052-P1-K1-A8
attttctctttatccaaacagagaaaagacccagggaagccaacttaccggaaacctgaaacgatggcgtttcgtttgagcaacaacttatttggaatcctcaactcgattaccttcctcctctcgatccccatacttggcgccggtatctggctgagacgagaaggcgtaacagaatgcgaacagttcttggacacgcccgttatcataatcggagtcttcctcatgttggtctcgctcgcgggactaattggcgcgtgctgtctcgtgactttgctactctggctctacctggtcgtcatgttcctactgatcgtcctcggcatagccttcaccatcttcgctttcgtagtgacgaacaaaggtgcgggacatgtattatccgggaaaggttataaag

SEQ ID NO: 25578 - DNA, 391 bp, Gossypium hirsutum
  Clone ID: LIB3272-052-P1-K1-A9
atagccccgaagcccaaccccttcccccattgaatttgatattttataaaaaaggatggggctgtcttttgctaagctgtttagtcgactgtttgccaagaaagagatgcgaattcttatggtgggtcttgatgctgctggtaagactaccattttgtacaagctcaagctcggtgagattgtcactaccattcccaccattggctttaatgtggagaccgtagaatataagaacattagcttcactgtttgggatgttggtggtcaggacaagattcgacctttgtggaggcactatttccaaaacactcaggggctaatctttgttgttgatagcaatgaccgtgaccgtgtggttgaggccagggatgagcttcatcgtatgctaaat

SEQ ID NO: 25579 - DNA, 396 bp, Gossypium hirsutum
  Clone ID: LIB3272-052-P1-K1-B11
gcagaatcaagggattgtgggtggagaagaagcggtgacggatctaacttggaactccgttttctcttcttaccgctattcccgacctatctctaaccccctcaatttctctcaggtcgatattccttgcgttcaagcgtcttcatggcttcaaagcggattttgaaagaacttaaggatttgcagaaggatccaccaacttcctgtagtgcaggtcctgtagcggaagacatgtttcattggcaagcaacaattatgggcccctccgatagcccttttgcaggaggtgtgtttttggttaatattcattttcctccggattatccattcaagccttctaaggttgcatttaggaccaaggtcttccatccaaacatcaacagcaatgggagcatt

SEQ ID NO: 25580 - DNA, 394 bp, Gossypium hirsutum
  Clone ID: LIB3272-052-P1-K1-B12
cttaaccatttcccaaatctcctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgatgtgcctgctggcactgctatggctcgtatttggggtcgaaccaattgcaatttcgatgccagtggtaggggtcattgccaaaccggtgattgtggtggactccttcaatgcaaaggttggggtgtacctccaaacaccctggctgaatatgcacttaaccaatttggaaacatggatttctacgacatttccttagttgatgggtttaacatccccatggtgtttggt

SEQ ID NO: 25581 - DNA, 404 bp, Gossypium hirsutum
  Clone ID: LIB3272-052-P1-K1-B2
gaaaaagaacgcagtcttttgatctctgccccaaagcaaaaagttgtcatcttttacaatcacaactactggttatttattttcatggctcaaggagattctaacttccagcaagacatggctaaagaggaagaagaacagaggctgaaatacttggagttcgtgcaagtagccgccgttcacgccgctttgtgcttcaccaacctttacctttacgctaaggaaagatcggggccgttgaaacctagcgtcgagaccgttgagggaacggttaagagtgtggttggaccggtttatgataaataccatgatgtccctgttgaattccttaaattcgttgattccaaggtgggtgaatcagtgaccaaacttgatcgtcgagtccctccagtcatcaaacaggt

SEQ ID NO: 25582 - DNA, 408 bp, Gossypium hirsutum
  Clone ID: LIB3272-052-P1-K1-B3
aagatatctacttcattgctttcttttagctcttcttactaccaaagcagcatctcatctttttcaatccaatgccaatgccaatgccaatcgaaagagctatattgtgtatatgggtgaccgacttaaagatggagcttccacagctttgcttcatggcagcatggtacaagatgtttttggcagtgagtcgaagacagtgctgtacagctacaaaaagagttttaatgggttcgtggtggatttgactgaggaagaagcacaaaaaatggccggaatgaagggcgtagtatcagtgtttccaaatgaaaagagaaaactacatacaacaaggtcatgggattttatgggattccctcaacaagttgaaagagcaaccatggaaagtgatgttatcattggagtttt

SEQ ID NO: 25583 - DNA, 393 bp, Gossypium hirsutum
  Clone ID: LIB3272-052-P1-K1-B4
cttttagggggggggggtttagatcgtgtgctttttttcagtttctcaaaaaccatggcgatttcttcgactttttccgctgctaaattggatagtttgttgatgaattattgttcatcgtcttcggcttctttttctggggcttattttcaagatcaacaacaaaagaaggtctttcccaggcctaatcatggaaataaaggtatggtttcgaggaatgggggagttagatgtgaagctgctgaattcaacgccgctttgggaccccaaaaaatcgatctttctaaggcttctgcactgtcagctcttcaacaactcaagacatctgcggctggcagatataccaagggaaggggcaacattggtgtcatagggctcaatgttcacactgca

SEQ ID NO: 25584 - DNA, 284 bp, Gossypium hirsutum
  Clone ID: LIB3272-052-P1-K1-B5
ttttaagtgtgattaatgtgtttttttacttgatctgttgctgggcttttggatctagtgacaacaaaaacaaaatagtatgggatgaagaggaaggcactgaagatgaactagaactagaactaggtgaccatgccaagggagtggcatctcccattgtttttactcattgatctttcaatgctatgtttttacctagaatttgtgtagcacaatttattttctctttttcttttgtttttgttattatataaataaatataagtagctatgttttttcatgt

SEQ ID NO: 25585 - DNA, 272 bp, Gossypium hirsutum
  Clone ID: LIB3272-052-P1-K1-B6
aaaaaagaaccccacagataagaaaacctaatatcccaaagcccaaatcaaagccaacacctctcgagtagaatcccatcaaatttctgatcaaccaaacagaaatctcatcctcgtacaaccccacttctcttttcaaatgagatagaaagaaggtgtgggattaacatagatagaggtagaaagtgagttcttatttgatcttgcgaaggatgtctgcagcagcgtgcggtagcaagagatctttattataggatatcccgtcatcgcca

SEQ ID NO: 25586 - DNA, 282 bp, Gossypium hirsutum
  Clone ID: LIB3272-052-P1-K1-C1
ttaattttatagctttaatatgcaatttttctttaagaccattaccaataagaccataacctttgcagtggaaagcacactctccattgatcgtgtgaagggcatgatccgatataacagaagaatgcgccacgatcaacacaggcttatttttgatgatgaaacctttttggatggagagacactacatcactacgacattgaggaggagaacacccttcacttgtaacatatattgtggggtgagatgcaaatgtaagtataaaccgtcaacgcactgac

SEQ ID NO: 25587 - DNA, 406 bp, Gossypium hirsutum
  Clone ID: LIB3272-052-P1-K1-C10
gtgagggtgacaagaaaaggaagacatcggtggtgtatctgaagtgacagaagcggatggccgctagcgttctgaagtgtggccgggacgaggatcggctcgttcctaatgaaatgaatgaaatcttcatggccaactgcaggcagaatgttatgaaactagccaaggcatggttatatcattcgagagcctacacaagatccactactagaactcgtgcacgcaggatgaaagaggccacgagacagggtggacatcatgactatggtaagaggaacgataccagggaggctagattgcatacaaagatcctgtggatgatgagaatgcatgtactaaagcgttggcttcgtatgtacagagaatgcaagactgatgacaagctcatgtaccatgacatgtacat

SEQ ID NO: 25588 - DNA, 399 bp, Gossypium hirsutum
  Clone ID: LIB3272-052-P1-K1-C12
gttttgatgattccggtatgccggaggttcctgctaagtggcgtggtgagtgtgaatcggctcctgattttaatcccaagttttgcaacaggaaactcattggagctcgaagcttttcaaaaggttaccgtatggcatccggcggtggtgggatttacaaaaaaccgggagagatccagtccccgcgtgataaagatggtcacggtacacacactgctagcaccgccgctggatctcacgtggcaaacgctagtctcctcggatacgctagcggaacggctcgtgggatggcgactcacgcccgcgtcgccacctacaaggtttgttgggaaacgggttgtttcggatccgacattctggccggtatggaacgggcaatcgaagacggcgtcgacgtcc

SEQ ID NO: 25589 - DNA, 354 bp, Gossypium hirsutum
  Clone ID: LIB3272-052-P1-K1-C2
gttccacgaaaacccaccttgaaatttgccaagtttatcactatgatacaccatgccgtctggctgacaacaggtcgcgaatctccacaggccgccacgcctgcaaatgaggtgcctggtcacatgacccactccatgccatctaacgagattgagatctttaaatgttggcagggctggagttataacaactgtttgactcacctcacaccattggaacaaatgaggcaaccgtccggctctcttacagatactaaatctgacggattgtatgatcaagtgaaacagcttagggcatggacaaagcagatccccgattgttactcgggcgctgtggttcttaatatcatcacc

SEQ ID NO: 25590 - DNA, 389 bp, Gossypium hirsutum
  Clone ID: LIB3272-052-P1-K1-C4
atccatcatgtctccaataaaaactagctttatatccttacttatcatcggttccatgggcgttgctgtcgccgtcgccgacaagacacacgtcatagatttccaatggcctaacctctacccagaaggcatggcctgggacctattagcccagcacttcatcgtcggttccctaaaccaccgtacaatccactccgtgtccgacgcaggcgttgacaaaactctgatctccgatcccgccctccctgaaaacgttactgttttaggtgtgacggtcgatttcactaaaaaccgccttctcgcttgcctccactctgtttcccctctacctacattcaacgccctcgtcgcctacgacctccgcacccgtcgacgactatttctctccc

SEQ ID NO: 25591 - DNA, 333 bp, Gossypium hirsutum
  Clone ID: LIB3272-052-P1-K1-C5
attttcgaggcattctttgattccctttacgacctgttcaaatttgctgatgactggattggtgaatttgtgattaagattgatggtattctccctccagtcatcaagcaggcaatatccaaagtcgcctcggctgccaataatgctttaggactgactgttgatgtgcctactatggaggtccagagtactggagtgaaaggcacctcctctagattcctccagcagatctcatccggagccatcttggttgttgaaggtgtggctagtcaggccaagaattccggattgattcctgaagagctacaagtgctgaagtacttaaaatactta

SEQ ID NO: 25592 - DNA, 399 bp, Gossypium hirsutum
  Clone ID: LIB3272-052-P1-K1-C6
gtgaggcggcggaggaagctaacgtccctgcagcggctgcggcggaagcacccacaacagggaccgagaagcaaccacataagcttgaaagaaagtggaccttttggtttgataaccaatcaaagcctaaacaaggcgctgcttggggttcctctttacgcaaagtttacacttttgacactgtagaagaattttggtgtttgtatgatcaaatattcaagcctagcaagttgcctggaaatgctgatttccacttgtttaaggctggaattgagcccaaatgggaagatcctgagtgtgctaatggaggaaaatggtctgtcactagcaacagaaaggctaatcttgagaacatgtggcttgaaagtttgatggcattgatcggggagcaatttgatg

SEQ ID NO: 25593 - DNA, 396 bp, Gossypium hirsutum
  Clone ID: LIB3272-052-P1-K1-C8
ctttttggcaatcaattttgtaagcaagtatggctaatgacgttgaggatgctggtgagttccaagccaaggactaccatgatcctgcaccagctccattggtggacggggaggagttgacaaagtggtcattctatagggatggaatagccgagtttattgccacgctcttatttttatacatcactgtgttgacagtgatcggatacaagagtcaggttgaccctgatcagggcagagactaatgtggtggtgtaagcattcttggcattgcttgggcttttggtgagatgatctttcatgatatttactgcactgatggtatctctggatgacacatcaacataccacagacctttgggcttttgttgactaggaacgcatgcttagttcgag

SEQ ID NO: 25594 - DNA, 401 bp, Gossypium hirsutum
  Clone ID: LIB3272-052-P1-K1-D1
cttctctgggcctctcctgtttcttgctcctaaaacatatagtcgcctgcttcgaacttagttgagaaagatagatgcttaggttaaatgtttattgttctctaaatattcctattccggaacatattaagcttgggagtagttatggttcaggcttacctaagttccgtggtggacccaagctgcctcgtcgggtttcagtcagggcgttaaaagatgagatggacggtggtatgagcggcggctttcaaggcccgaagctgggaacctggcttggaaattgaggtcccttttgaacaaagaccggtgaatgagtactcgtccctgaaagatggacctctgtattcatggggcgaactgggaccaggccaatttttccttcgactaggaggactcttgct

SEQ ID NO: 25595 - DNA, 388 bp, Gossypium hirsutum
  unsure (1)..(388): unsure at all n locations
  Clone ID: LIB3272-052-P1-K1-D10
caaagctataaagatggagaagattgagcacaccacggtgaccaccaacggcataaagatgcatgtggcatccattggctccggcccaataatccttttcttacacggcttccctgagctttggtacacctggcgccgccagcttctttcgctctcatcccttggctaccgttgcgtcgctcccgatctccgtggctacggtgacagcgacgcccctccatcgcccgaatcatacactgtttttcacgttgtgggggatctcgtaggcctcctcgacgcccttggtgttgacaaggtgttcttggtggggcatgattggggtgcgatgattgcttggaatttttgcttgttcaggcctgatagaatcaaggctttggtcaactngagc

SEQ ID NO: 25596 - DNA, 403 bp, Gossypium hirsutum
  Clone ID: LIB3272-052-P1-K1-D11
ctttttcattggaagcttctcttccaaagatggactatgtgtacggaccaggaaagaaccatctctttgttccagggccggttaacatcccggaaccagttcttcgagccatgaacaggaacaatgaggattaccgttcccatgccattcctgccatgacaaaaactcttcttcaagatgtcaagaaaattttcaagactactactggaactccctttttgattccaactacaggaactggtgcatgggagagtgcactcactaataccctgtcccctggagatcgaactgtatcttttctaattggacaattcagtctgctgtggattgatcaacaacaacgcctcaacttcaacgtctacattgttgaaagtgagtggggtcaacgtgctaaccttgacat

SEQ ID NO: 25597 - DNA, 401 bp, Gossypium hirsutum
  Clone ID: LIB3272-052-P1-K1-D12
atttagatcttgaagtgtgagatggcgacaacatcagcaacaaccttctcaattgggtcgactgtctccttcggaagcaggggaaatccacttccacaatctaaaccttttgttgcgaggttcacctgcccaaattcacttgcaagttttagtggtctcaaggcagcaacatatgtgaactgtgagtcagagtcctcattcttcaccaaggaaagcagcgccgctcttagaggctcatttgtaccaaaagcacagaaagcaaaccagaagtctcagaatggtctacagcctgtggcatgttacaaagtcgcaatacttggagctgctggagggatagggcagccattatcccttataatcaagatgtctacattagttgcagccctgaacctctatgatat

SEQ ID NO: 25598 - DNA, 338 bp, Gossypium hirsutum
  Clone ID: LIB3272-052-P1-K1-D2
aaattgaatcttattactttacaataataaagggttgcgggaagtaataggtggttgtacctgaccctgaactgacacatcagtatgctgcaagcacatctaaattgtttattctgtgaagacctactgttctgatgccaatattgtgagaatggagcgcggtgaatataacgctttgagcaacagtactgcgcactatttgataatgtcttgcgtacatgcatggctgattctgctattgcagatcaagcacatgagagacagatggatgaaggtatcaattgttgaatcgatgagggctgtgtactgatctcgcctatggaccatgtatcaaggag

SEQ ID NO: 25599 - DNA, 394 bp, Gossypium hirsutum
  Clone ID: LIB3272-052-P1-K1-D3
aaaaaatgagctttcttcaggccttgtcagttttccttttgtttttgtcgtatgtagtcgtaggatcagctgagcagtgtggaaggcaagcaggtggtgctctttgccccggtggtctatgttgtagccaatttggctggtgtggcagtactgctgactactgcacagttcctggttgccaaagtcagtgcagcggtagtggccctgcccctgggcctggtgggctaaccaatcttatatcaagagagacgtttaatcggatgcttttgcataggaacgatggggcttgtcctgcccgtggcttctatacatatgatgctttcattgctgctgcccgttcctttcctgcatttgctacaactggtgaccaagctactcgcaagagggaaatagc

SEQ ID NO: 25600 - DNA, 397 bp, Gossypium hirsutum
  Clone ID: LIB3272-052-P1-K1-D4
ccgtttcctcatcggttgccttggtgcactagctcctcttcccctgtcctctatttgctcactcggaggtgttaacctaaactatagctcaattgaagcctcccttccagctgtagaagcaactcaaaaacaccccggtgatcccactgcagttgccgttgtggaggtcacacaagatggccgccataagattttaggagaaatctcggcctcaaaactatggaaatgtgactatttagctgcagcttgggcattagccaacctctcagccggacaatttgttatgggggctgaggataatgtgagttcaagattgcttcctgatatttcggttaattcaacagttgaagataataaggtagcgaatggtggtgggtcagcaagggcaagaaaattc

SEQ ID NO: 25601 - DNA, 390 bp, Gossypium hirsutum
  unsure (1)..(390): unsure at all n locations
  Clone ID: LIB3272-052-P1-K1-D5
ctagcaagagcagtgctgcggcatttcttcctcaaaagacccgtcaaacagaaatgaagttcaacattgcaaatccgactactggttgccaaaaaaagctggaaattgatgatgaccagaaacttcgagccttttttgacaagaggatctcacaggaagtcagtggtgatcccctcggtgaggagttaaacggctatgtattcaagatcatgggaggctgtgataaacagggttttccaatgaagcaaggagttctcactcctggacgtgttcgtcttttgcttcacagaggtactccctgcttccgtgggtatggtaggagaaatggagagcgcangaggaagtcagttcgtggatgcattgttagtcaggatctttcagttttgaact

SEQ ID NO: 25602 - DNA, 395 bp, Gossypium hirsutum
  Clone ID: LIB3272-052-P1-K1-D6
gctaaatcttatttacctgcaaactttgggtttatggcttcaagaatgctgctttttgggctgtttatggtatccctatataccacaagtgctcaaataggtgtttgctatggacagctcggcaacaacttaccatcaaggcccgaagttatatccatcttcaaccagagaaacattagaagaatgcgactctacgcgccagaccaacctagtctccaagctctcagaggaaccaacattgagctgatgctcggcgttccgaattccgatcttcaacgtatcgcggctagccaagccaatgcaaacatctgggtccagaacaatgttagaaactttggcaacgttaagttccgctacattgctgttggaaacgaagtccaaccttccgatccggc

SEQ ID NO: 25603 - DNA, 398 bp, Gossypium hirsutum
  unsure (1)..(398): unsure at all n locations
  Clone ID: LIB3272-052-P1-K1-D7
ctttggagaaatatgtcagctcctacactccccatggcagccggtgttgcagctgtctcttcttcactttacaataacaccaaaccctcctctcttttttcttcatcgattcacttccttccttcaagacttagctctaagcagttaaaaccttccaacctcaaaacccaaagcctcaattccctttcctttgtctcttaacttatctctcccacgtctgccctgcttttcagcagcttttgacagcttccaagttactgaagatgaccaaagcagtggagaagaatacccagaaacagaatctcaagaccttgaagaacaaccacaacangaggaagctgaagaagataaggttcagagtctggcggtgaaaaaggaaagtgtatgttgggaattgc

SEQ ID NO: 25604 - DNA, 418 bp, Gossypium hirsutum
  unsure (1)..(418): unsure at all n locations
  Clone ID: LIB3272-052-P1-K1-D8
ggcgcgacccacgcgtncgtaaattcataaaacatcccttcccgtcttcagccggaggtaagtcatggttaaacataacaacgttgtgccaaatgggcacttcaaaaagcactggcagaactatgtgaaaacctggttcaatcagccagcaagaaaggctagaagaaggattgcaaggcaaaagaaggccggtaggatctttccaagaccaacttctggacctcttcgcccaatcgtccatggccaaactttgaagtacaacatgaagttgagagctggcaagggtttcactcttgaagagcttaaggctgctggtatttcaaagaaacttgcacctaccattggtattgcagtcgatcaccgtcgtaagaacaagtcccttgaaggtcttcaagccaatgttcagaggcttaaaact

SEQ ID NO: 25605 - DNA, 346 bp, Gossypium hirsutum
  Clone ID: LIB3272-052-P1-K1-D9
atcgcagactggttgtttgttttccaaattgcactaaattcccaaaactgcaaatttcatttcaaaacccttaaaggttcaattcctactcttcttttttatgaacgttggagcttgcaaaacatttttctcggtttccagtttgagcgcacaggagaatgttgttcggtcatgctgatggtctatctgaacaacggtcaccaagggaccagctactcgctgatcctgaatcgctggaagatgatttcaaattagacagttctgaaacgatattgtacgctgcttcttttgaagaactcgccagagataatcttcaatatgacaccatcatatgggtttctatatc

SEQ ID NO: 25606 - DNA, 189 bp, Gossypium hirsutum
  Clone ID: LIB3272-052-P1-K1-E1
atcgcagactggttgtttgttttccaaattgcactaaattcccaagatcttcactgggatttgaaaacccttaaaggttcaattcctactctttttttttatgaacgttggagcttgcaaaacatttttctcggtttccagttggagcgcacagaaaaatgttgttcggtcatgctgatggtctatctg

SEQ ID NO: 25607 - DNA, 438 bp, Gossypium hirsutum
  unsure (1)..(438): unsure at all n locations
  Clone ID: LIB3272-052-P1-K1-E11
cggaanncccgggacgacccaggcggcccacgcaaccaagctcnctncagcacccgcaatacaaaaacaaatcgaaagggcatccccgcgctgggggtaccttacttggccgccatgattattccagagaagaatcccagagaaatctgcaaatacctatttcaagagggagtttgctatgcaaagaaggattacaatcttgcaaagcaccccgagatcgatgcacccaattagcgggtcattaaactgatgcagagcttcaagtccaaggaatatgtccgcgagacttttgcttggatgcactactactggtaccttactaatgatggaattgagtttctcagaacttaccttaatcttccatccgaaattgttcctgctactttaaagaaatctgcaaggccacccggtaggctaggcggcccacctggtgatcgc

SEQ ID NO: 25608 - DNA, 399 bp, Gossypium hirsutum
  Clone ID: LIB3272-052-P1-K1-E12
cacaaacccatatatgcaatactgtttcatttttcagcaaagctagaaagacaatgactaagggtatatgagactgcacaccaacgcgaaggggtgtttttggccaaagactaccatgatccaccacctgctacattgattgtggctgaagacataaccaaatggtcgtttaacagggcaaagattgccgagatcattgctacacttctcttcctgtatgtcactgtgaagaccgtgattggttacaaggaccaaaccgacccttctaagaacacttgtaacccctattgccgggtcgatggtattcttcgtattgctttgactttgcagagcatgatctatattcttgcttactgcaccgctcgtgtatgttgagggcatatcaacccggctgctaca

SEQ ID NO: 25609 - DNA, 400 bp, Gossypium hirsutum
  Clone ID: LIB3272-052-P1-K1-E2
cttccaccaaaggccacccttagatctcccaagttttccatgatctccaccattccttctggctccaaagaggttgggaatctgaaaaagcctttcacgcctccaaaggaggtgcctgttcagatcacccactccatgccgcctcacaagattgagatctttaaatctttggagggctgggctgagaacaacattctgactcacctcaaaccagttgagaaatgttggcaacccgccgactttcttccagatcctaattctgatggatttcatgagcaagtcaaagagcttagggaaagggcaaaggagatcccagatgattactttgtagttttggttggtgatatgatcaccgaggaagccctttcaacttatcaaacaatgcttaataccttggatg

SEQ ID NO: 25610 - DNA, 396 bp, Gossypium hirsutum
  Clone ID: LIB3272-052-P1-K1-E3
cttttgggaattacctcaaacaaaaattgttggaagtgtgtaatgaagaacagagaatgcagattctgttaatggttacagaagaaccagggcaacttgttagaatatctctcaacactcatggcactcgtgtagttcaaaagttgatcgagactctcaaaaccaggcagcaaatttcactggttatatcagtacttgagcctgggtttctatctctcatcaaggacctgaacggaaatcatgtcgtgcagcgttgcttgcaatgtcttagcagtgaagataacaagtttatctttgtagctgccgcaaagtattgcgttgatattgcaactcatcagcacggctgttgcgttgcaacgatgtattagccattcaactggtgagtatcgagaaaag

SEQ ID NO: 25611 - DNA, 402 bp, Gossypium hirsutum
  Clone ID: LIB3272-052-P1-K1-E4
caagagccaccattgctgcttcagctttatctttctgttattaccattactcctacagcttcattctgtcaaaggtgatctccagttgaactactatgctcaaagttgccccaatgctgaagagatcatcaaacaacaagtcatcaagctctacaacaaacatggaaacacagctgtttcttgggttcgaaatctcttccatgactgcatggttaagtcatgcgatgcatcgttattgttagagacggtgaatggaattgaatcggaacaaaaatcagataggagttttgggatgagaaatttcaagtacgttaagacaattaaagatgctctggagcaagaatgtccagggacagtttcctgcgctgatatcgtctctctttctgctagagatggcattgt

SEQ ID NO: 25612 - DNA, 403 bp, Gossypium hirsutum
  Clone ID: LIB3272-052-P1-K1-E7
ggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgctggttacaaatgtgct

SEQ ID NO: 25613 - DNA, 403 bp, Gossypium hirsutum
  Clone ID: LIB3272-052-P1-K1-E8
acatcaatggctgctatgctccttctagggctcttcgctgcaaacttggatcctactgctgcacagattggtgtttgctatgggatgcttggcaacaatctcccaaattcatgggaagtcattcaactttacaaatcaaacaacatccggcgattaaggctgtacgatccaaatcaacaagcattacaagctcttagaggctccaacattgaagtaatattaggtgttccaaatgatcaacttcaaaacctcgctgacccttccaaagcacaatcatgggttcaatcaaatgttgtagcttattggccgagcgtttggttccgatacattgctgtcgggaacgaagtccctccttcatcttggttagctcaattcgttttgcccgccttagtgaatgtattca

SEQ ID NO: 25614 - DNA, 400 bp, Gossypium hirsutum
  Clone ID: LIB3272-052-P1-K1-E9
aattctttccttcactttctcgagaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaaggtctataattatgtctctctctgtcttgtgtaat

SEQ ID NO: 25615 - DNA, 396 bp, Gossypium hirsutum
  Clone ID: LIB3272-052-P1-K1-F1
aaaaaaagaaaaagtttgaaacccggaaatgtcggacgaggaacaccattttgaatccaaggccgacgccggtgcctccaaaacctacccacaacaggccggaaccattcgtaagaatggttacatcgtcataaaaaaccgtccctgcaaggttgttgaagtttcgacctccaagactgggaagcatggtcatgctaagtgtcactttgttggaattgacatcttcaccgccaagaagctggaagatattgttccctcttcccacaactgtgatgttccacatgttaatcgtactgactaccagttgatcgacatttctgaggatggatttgtgagtttgctgaccgaaagtggagacactaaagatgatcttgggctcccaactgatgagaacct

SEQ ID NO: 25616 - DNA, 395 bp, Gossypium hirsutum
  Clone ID: LIB3272-052-P1-K1-F10
gaaaattaagcgcgtggtttggacctgacgtagaaggccactaccaataattcttctataaatttcgattccttccaccacctctgcttcatactaacgccaatcaatatcctcttcttcctcttccctcagatttttttctcttttcccaaagcaaaacaaaagccatgtctcagactgttgtgctcaaggttggcatgtcatgccaaggatgtgttggagcctgtaagagagttctggggaaaatggaaggtgtggaatcatatgaagtagatttggagcaacagacagtgactgtgaagggcaacgtccagcctgatgctgtgctgcagaccgtgtcaaagaccggcaagaagactgccttttgggaagcacaagctttggctgaatccgag

SEQ ID NO: 25617 - DNA, 298 bp, Gossypium hirsutum
  Clone ID: LIB3272-052-P1-K1-F11
gccatggcagaccgtatgcttcttgggttaggtgtcctgctactctgccttgcaaaggtttcatctgatctgaaggcagaagaagttataaccaatgtcggtgaggtgggttctttggttaccagaggcggaaacagatgactgatgctagagattgattgaggagggttctgcaggaaaagatgcagctaacactcgaggccatacagatgcaacagggcgtgtgtgacttgatggtagaggtgcacgttcttgcgagcgtttgcatggagaaacagggaggtcctactatcctgtt

SEQ ID NO: 25618 - DNA, 399 bp, Gossypium hirsutum
  Clone ID: LIB3272-052-P1-K1-F12
attttgtaagcaagtatggctaaggacgttgaggttggtggtgagttccaagccaaggactaccatgatcctccaccagctccattagtggacggggaggagttgacaaagtggtcattttatagggctgtaatagccgagtttattgccacgctcttatttttatacatcactgtgttgacagtgatcggatacaagagtcaggttgaccctgataagggcagtgacgaatgcggaggtgttggcattcttggcattgcttgggcttttggggggatgatctttatccttgtttactgcactgctggtatctctggaggacacatcaacccagcagtgacctttgggcttttcttggctaggaaggtgtccttagttcgagccatattttatatggct

SEQ ID NO: 25619 - DNA, 394 bp, Gossypium hirsutum
  Clone ID: LIB3272-052-P1-K1-F2
aaatgatttgactgaagtagtcaaagaaatgagtgaagaaggcaaagaatacctctcaacggctgccgagaattcccctcctgaagtcaaagaaatcgttgagaccttctcttcctccgccgaagatttcaatgacgtttccaaagttcatgactttcatgtcggtataccttatggttttattctttcagttgggggatttctttctttcatggtgacagggagtatatctgccattaggtttggtattattctaggtggagctcttttggcattaagcgtatcgagcttaaaatctcataaaagaggagagtcgtctcctcttgccatcaaaggacaagcagtgatctcatctgtactacttttgagggagttaagcttgctgattcggaga

SEQ ID NO: 25620 - DNA, 392 bp, Gossypium hirsutum
  Clone ID: LIB3272-052-P1-K1-F3
gttcttctcccctttccccctttctccctttctttccctctcctaaactaacgtttcaaaccacactccctttacctcaaaagctctctccttttcttgtttttgcggaaagaaaatgaatcccgctgataacactgaccaccctcagcttccaactatcaagatccaccacccatcatcccctcaccaccctacctgtgctgctacccccaccccaacatccggtgcccgacgtaagatcggggtagccgtcgacctctccgatgagtctgcttttgccgttcgttgggctgtccagaactacctcaggcccggtgacgccgtcatccttctccacgtgtcccccacttcagtactctttggagctgactggggtccactccctcaaaccc

SEQ ID NO: 25621 - DNA, 402 bp, Gossypium hirsutum
  Clone ID: LIB3272-052-P1-K1-F4
cacaaacccaaatctccaattctgtttcatttttcagcaaagctagaaagacaatgactaaggatattgagactgcagagcaacgtggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcaccgctggtatctctggagggcatatcaacccggctgtgacattcg

SEQ ID NO: 25622 - DNA, 388 bp, Gossypium hirsutum
  Clone ID: LIB3272-052-P1-K1-F5
gaactctcctgatcgtgcttgcactctcgcaaaacaggcttttgatgaagccattgccgagcttgatacacttggagaggattcatacaaggacagcactttgataatgcaacttcttcgtgataacctcactttgtggacctcagacatgcaggatgatgggacagatgaaatcaaagaagctcccaaacaagaggatgagaaacaaccgtgaagtctctaatcttcatgggagtgttttacttctctggttgtttttgtatggagaagtcgctcggtcctactatcgtcttcaattacttgtttttagtagatcacgcctcaatttatgaaccttggaagtactcctaagaatttcttagtgtttcactggttatttgttttgagt

SEQ ID NO: 25623 - DNA, 402 bp, Gossypium hirsutum
  Clone ID: LIB3272-052-P1-K1-F7
aaaaaagaaccccacagataagaaaacctaatatcccaaagcccaaatcaaagccaacacctttcgagtagaatcccatcaaatttctcatcaaccaaacagaaatctcatccccctacaaccccacttctctttccaaattagatagaaagaaggtgagggattaacattgatagaggtagaaagagagttcttctttgatcttgcgaaggatgtctgcggcagagtgcgggagcaagagatctttcttcgaggatatcccgtcatcgccatcggcttctgtctctaagaagctccggcgctgctcgccttaggctacttcttctgttcgtgttgctacgccgccttctctacttgatcacctccaagctctcttccctcatatggaccccgagcttctgg

SEQ ID NO: 25624 - DNA, 403 bp, Gossypium hirsutum
  Clone ID: LIB3272-052-P1-K1-F8
ctttttcactttatgaagctttcatttctactccactctttttctcatcttcagatctcatctccttccctaaggttaaccaatggcaacagttcgaaatctgaaaatcaagacatccacttgcaaacgaattcttaaagagcttcactcatatgagaaggaagttgaaagagaagctgctaaaacagctgacatgaaagagaaaggagctgacccttgtgacctaaagcaacaggaaaatgtgctggctgaatcaaggatgatggtccctgattgtcacaagcggctagaggcttcattagctgaccttaaagcaactttggctgaattggaggaagcgaatgagaaggaaggccctgaattcgaagatgctcgcagcaccatcatcgaagttgaaaagttg

SEQ ID NO: 25625 - DNA, 393 bp, Gossypium hirsutum
  Clone ID: LIB3272-052-P1-K1-G1
ttctcatttagcattacgataaccaatcatggtagttatgcacccacttttccgatcctcagataaatcgggaatttaaccagtttttgcccaccattttcatcttcaccccaagcacgcttgaactcttcaaccacatgctcgctcaaaagctccacacccttctccttacccttctgatacgcggaccatgatcttaaataagtaaagtaatcctctaaacccatccatctctcattctcaaactcaaacggtcccgtactatcctctccatcgactgcctcgaacggaaaatcgatggttttgtacttatcatccaccatctgtcgtgctgaatcccagtatgggtttttgtaaaatcgttcaagcaccttgtccatggagtcgttgact

SEQ ID NO: 25626 - DNA, 408 bp, Gossypium hirsutum
  Clone ID: LIB3272-052-P1-K1-G10
ctcactcgccgactcgcctctcgcttattggttcaagatctggttttgatctgatcagatcggataaaaatatcaaaacatgtttgggagagcaccgaagaaaagcgataataccaaatactatgagattttgggagtatcgaaaaacgcttctcaagatgatctaaagaaagcttatagaaaagccgctattaagaatcatcccgataaaggcggcgatcctgaaaagtttaaagagttggctcaagcttatgaggcgctgagtgacccggagaagcgtgagatttatgatcagtatggggaggacgcccttaaagaagggatgggcagcggtggcggaggacatgaccctttcgatatcttccagtcattctttggtggcaatccttttggtgctggtggaagcag

SEQ ID NO: 25627 - DNA, 448 bp, Gossypium hirsutum
  Clone ID: LIB3272-052-P1-K1-G11
gcccgcggcacacggtccggaattgaccgacgcgtccacacatacgggccaacgctgaaaattatatcatcgaaacaataccttcggctccaacttcagctcaaaaatatgtcaggggacgaagtggcggctgcccaacccgaggcggcgcctgcactcggtgagccaatggacatcaacacagccttgccccttgtggttaggaagtcacgagctcacggtgggctcgcacggggcttgcatgaagctgccaaggcaattgaaaagcacaatgcgcatctttgcgttatagctgatgactgcgaccagccggactatgttaagctggtcaaggcactttgtgctgatcataatgttaaagtgctacgtgccccgagcgcaaaaacactccgcgagtgggctggtttgtgtaagatagactctgaaggtaaagcacgaaaggtagttg

SEQ ID NO: 25628 - DNA, 413 bp, Gossypium hirsutum
  Clone ID: LIB3272-052-P1-K1-G12
gaaagtttcaatggcaaccctcaaagttccagttcacgttccttctgcttctgaggatgctgagcaacttcggaaagcttttgaaggctggggcacgaacgagcaattgattatcgacatattggctcacaggaatgcagcacagcgcaattcaattcggaaagtttatggtgaagcttatggggaagatcttctcaagtgtttggagaaggaacttacaagtgatttcgagcgggctgtgctgctttttacgttggaccctgcagagcgagatgctcatctggctaatgaagctacaaagaagttcacatcaagcaattggattctcatggagatagcttgcagtaggtcttcgcatgaactactcaatgtgaaaaaggcgtatcatgctcgttataagaaatcccttgaag

SEQ ID NO: 25629 - DNA, 388 bp, Gossypium hirsutum
  Clone ID: LIB3272-052-P1-K1-G2
cacctacactgtttaacgccaagacacaggaaagcaacaccttttcttcagatccttctgaaaatcacgcaatcatgtcacgtggaaaataaccccaaaagatccaaaaacccaatattcctttttcattgttcttcccattttcagtttctcaaatgcaaaaaaatgttaaagactgtaattttcttttttatactaaactggttttaacctttaagctcatcaatggccgcatcttcactttcgaaatgcaacaccggttctctgaaccagtaaagaattggtctaactccaccggaaaactctctcattggcctttaaaagattcttttgaatactacgccgttttagctcaccgggatcgtctcctacgtggccgtaaactctc

SEQ ID NO: 25630 - DNA, 394 bp, Gossypium hirsutum
  Clone ID: LIB3272-052-P1-K1-G3
tgaatttctcagaggatgtgggctgcttcatgtcttgcatcttgttgtgcggcatgtgcctgcgatgcatgccgcacggtggtttcggggattagtcggagatctgcaaggatcgcttattgtggactttttgctctttctcttgttgtttcgtggatccttcgtgaggttgctgccccgctgatggagaagctcccttggatcaaccatttccataaaacacccgacagggaatggtttgaaacggatgcagtgctgcgggttagcttgggaaactttctgttctttactatcctagctttctcaatggttggtgtgaaaaaccagagggatcctcgtgatgctgtgcaccatggtggatggatgatgaaaattatctgctggttcattttag

SEQ ID NO: 25631 - DNA, 401 bp, Gossypium hirsutum
  Clone ID: LIB3272-052-P1-K1-G5
tcgcccagctgctgcaaattatctctcgaaacagtacctccggttccaacttcagctcaaaaatatgtcaggggaagaagttgcggttgcccaacccgaggcggcgcctgcactcggtgagccaatggacatcaacacagccttgccccttgtggttaggaagtcacgagctcacggtgggctcgcacggggcttgcatgaagctgccaaggcaattgaaaagcacaatgcgcatctttgcgttatagctgatgactgcgaccagccggactatgttaagctggtcaaggcactttgtgctgatcataatgttaaagtgctacgtgccccgagcgcaaaaacactcggcgagtgggctggtttgtgtaagatagactctgagggtaaagcacgaaaggtag

SEQ ID NO: 25632 - DNA, 229 bp, Gossypium hirsutum
  Clone ID: LIB3272-052-P1-K1-G6
tgcagtgcaagtaaagttgtgtcaactctccaatggaaggaaggtttgttgtattctattatctgtttttcttttcttttaaattaacagtagggtttttctttcaaacttttgtgtttgaagatgaagctgcaagttgtagtttttgtttttttcgccttcaatatgaaaattttaatttaatattcattttcctctgctatccatcaaattcatggtttatatgtac

SEQ ID NO: 25633 - DNA, 400 bp, Gossypium hirsutum
  Clone ID: LIB3272-052-P1-K1-G8
aagaaagtaagaaaaaacactaaaacctccctgaaatctgagtccaggaaagaaaatctgaatgcaaatcacttgcttcttgaagagcccataagaatggcttccattcttgagccatcaaagcctagtttctttcctgcaatgactaaaattgtggggacacttggtccgaagtcgcgatctgttgaaataatatccgattgccttaaggctggaatgtctgtggcgaggttcgatttttcgtggggtgatattgaatttcaccaagagacattggaaaatttgaagactgctgttaaacgcactaggaagctttgtgccattatgcttgatactgggggtccagaattgcaagtagttaataaaacggagcaccccatttgccttgaagcagatacaa

SEQ ID NO: 25634 - DNA, 402 bp, Gossypium hirsutum
  Clone ID: LIB3272-052-P1-K1-G9
gcgaaaaggggaaaggaaacaactctccttccttccgacgataaaaacccttccccttcctcttgctcttcatttcaattcaatcttcctgagtcaaaggactgtgatggggcagcaatcgctgatctacgccttcgtggcacgaggcaccgtcgttttagccgactacactgagttctccggcaacttcacctccattgcttctcagtgcctccagaaacttcctgcttccaacaacaagttcacttacaactgcgacggccatacctttaactatctcgttgataacggctttacttactgtgtggttgctgttgaatccgctgggcgacaggtgccaattgcctttcttgagagaattaaggaggattttaccaagagatatggtggaggaaaagctgc

SEQ ID NO: 25635 - DNA, 389 bp, Gossypium hirsutum
  Clone ID: LIB3272-052-P1-K1-H1
aaaaaaatcacctactctctcactttgctctcttcttgttcctgtcctctttcaccaaactatcgccgacaacctctccaaaagaatggcatatgaagggattctgttggggatgggtaatcctctccttgacatttcgttagtcgtggacgaagagttcttgaaaaaatatgatatcaagttgaacaatgcaattttagctgaggagaaacaccttcccatgtatcaagaaatggcatccaagcccaatgtagagtatattgctggaggtgctactcaaaattcaatcaaagttgcacagtggatgcttcaaattcctggtgcaactggttacattggctgcattgggaaggacaagtttggggaggaaatgaaaagaactcaaaagc

SEQ ID NO: 25636 - DNA, 340 bp, Gossypium hirsutum
  Clone ID: LIB3272-052-P1-K1-H10
ctcctgctgagtttgctaagatcaataacaagcttgggatccggaaggaagacctgcccaagtgtgaagaacaactggagctaaaaattgccaaggcgcaattggaggagcttgagaaggatgctcttgaagcaatggaaacacaaaagaagcgggaggaatttaaggatgaggcaatgcctgttgtgaagtcattggacatccggaacttcatctgaaactcgaaattaccctttggtggttccagcttgagggggaacaaaggtaactgttcaacgagtgcttaaaacctttctttttcattttgctacaatgatatgatgatttataataatgaaaa

SEQ ID NO: 25637 - DNA, 402 bp, Gossypium hirsutum
  Clone ID: LIB3272-052-P1-K1-H11
cttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagtatctgaaaacgcttgaaagtgcgcttaatggaaagaaattctttggtggag

SEQ ID NO: 25638 - DNA, 57 bp, Gossypium hirsutum
  Clone ID: LIB3272-052-P1-K1-H12
cactcacctcttaaaacaaaaaccgtggttcaaggaaagaagacttttacaagacgt

SEQ ID NO: 25639 - DNA, 367 bp, Gossypium hirsutum
  Clone ID: LIB3272-052-P1-K1-H2
cggacgcgtgggcgcctctttcgagtggtgagtcaactaatcttgatattgggcagaatagttataactctgaaatgtcatataatccaacacctgaaatggttcagtatagtcaaccggtgacttttagttctgaaaatgttacattgcggcaaaatgtatctagtgctggaaggattggtgataacaaatacaatgggcaatatataaggaaaaccacaaattagccaagcattggatgggcctctactgcgccaacaacttccattcacgaaaatatgaacaatgatgattgttacctgccagagtctgcacagacaatggcatttaagaaagcgccacacgtgttctatggtgccaatgagcc

SEQ ID NO: 25640 - DNA, 379 bp, Gossypium hirsutum
  Clone ID: LIB3272-052-P1-K1-H3
ctctcttctttcctcctagcccaaaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctttgaggaaaccctttatcaaaaaaccgcttcgggcaagcccttcgttgatgttttgaaggaaggtggtgtccctactggcatc

SEQ ID NO: 25641 - DNA, 408 bp, Gossypium hirsutum
  Clone ID: LIB3272-052-P1-K1-H4
ataagccctccctccttttccaacctctccttcttctttgaaatttagctgaaatggctactgcaacaatgagcttcaatttggtgggagcatttaggggtctttctctagcatcaagctcgacgtcgtcctttatgaaaggagaagtgggttccattcacaaaacggcagtcgtttcgttcccgaggaagtctccgttccctttgacgatcgaatcggcgcacaaaaaaggagccggtagtactaaaaacggtcgcgattcaaagggtcaacgactcggcgtcaaaatctacggcgaccaggtcgccaagcccggcgctattatcgttaggcaacatggaaccaagtttcatccagggaaaaatgtggggcttggcaaggatcacacaatcttttcattgattgatg

SEQ ID NO: 25642 - DNA, 401 bp, Gossypium hirsutum
  Clone ID: LIB3272-052-P1-K1-H5
ctctttacccttctctcaccatgtcattgctgtctttttccttgttgttgctgtttgcttttagtgccaaagctgttgttcccccatctgaaacttttaggtttgtcaacgaaggggaatttgggccttttattgttgaatatggtgcagattaccgtgtcataagcatagctaatgcccccttccagcttgcgttttataacaccacccgtaatgccttcacccttgcgttacgcatggctacaacgcgttcggagtcgctcttccgatgggtttgggaggccaacagggggaaccctgttcgcgagaacgccacgttctctctcgggactgacgggaaccttgtcttggctgatgccgatggtcggattgcttggcaaagtaacactgcccacaaaggt

SEQ ID NO: 25643 - DNA, 349 bp, Gossypium hirsutum
  Clone ID: LIB3272-052-P1-K1-H6
gtcggctacggccgggcgatccggtcgaaagacattgacaggtggggagttaggctggggctgcacatgatgctaaaagataacgcccgtgacctaagatgcgctcaacaagaacagtaattttgtgtggcacaaaagggtaaacgctcgtttgattgttgtttacactacgaatactaaccgcaaaagcggagcctatcgcctctttacacctacatacttttcagctagagatgcttcaaaagttaccacaatgcttactcgctatgggcatgcattcggcattagctacgctgattggtgatcctactatcacggctacacctatcattgaaatcggaattcacta

SEQ ID NO: 25644 - DNA, 397 bp, Gossypium hirsutum
  unsure (1)..(397): unsure at all n locations
  Clone ID: LIB3272-052-P1-K1-H7
ttctcccgctccttttcgctgcgatttcgtcttcaagatctcagttctcaaatcgtagcgctcttttctatcaagccatggctctgatcttgcatgcaggaaaaacaaacaaaaatgcctttaaggccctcattgctgcagaatatagtggtgtgcaggtcaaaatggttgagaantttgagatgggtgtgtcaaataagactcctgagttcatcaagatgaaccctttggggaaggttcctgtgttggaaacacctgagggtccggtatttgagagcaatgccattgctcgttatgttgctcgctcaaaggttaacaaccctatatgtggttctacattgattgattatggtcatatcgagcaatggattgattntgcagccttggaaattgatgc

SEQ ID NO: 25645 - DNA, 405 bp, Gossypium hirsutum
  Clone ID: LIB3272-052-P1-K1-H8
caggtgatggaggagggagtttctcttcagaaactcatcaccaagaacaacaagtaggaaactttcatggaggctcaaactctttgctttcaactaacagtaatggcggctccactgctcctccaccagctaagaagaaaagaaaccttccaggaactcctgatcccaatgcagaagtgattgctttatcaccaaagacccttttggcgacaaaccgattcgtgtgtgaaatatgcaacaaagggttccaaagagaccaaaaccttcaactccatcgacgaggccataacctaccatggaagctaaagcaaagaaccagcaccgagatccgtaaaagggtttacgtctgccctgaaccatcatgcgttcaccataacccagctcgagccctaggtgatctcaccg

SEQ ID NO: 25646 - DNA, 401 bp, Gossypium hirsutum
  Clone ID: LIB3272-052-P1-K1-H9
cgattttgcatttagctgggaagaatgaaaatggatgtaaatttgttaagggtttaattgatgggattaaagctaaagagatgttgaatttgaaggatgaagatggtaacaccgtgttgcacttggctgctttgaggaaacagcatgaggtaatgaatttactactacaacaacctgaacttgatgtgaacgcagtgaattccaataatctaaaggctttggatatattgctaaaaggtccaaagcaatcaaatgatgaagagattgcccacatgctccatcttgcaagcatgccaaaactcgaaaaccaagtattaaccgacccatctcgacctaacaatgcagtggtcgatgcagtggtcgaagtagacatgacgatgaaagactcaacctcgaaaaag

SEQ ID NO: 25647 - DNA, 411 bp, Gossypium hirsutum
  Clone ID: LIB3272-053-P1-K1-A10
ctccactgactttcaccaccaccgtcactagcggcgccgtcacaaaatgtcgtcaacggagtctctcatcctccaactccatgaaatctctgccgttaaattcggtaacttcaagctgaaatctgggatcttctcccctatctacatagacctccgtctcatcgtctcttacccttccctcctccaccaaatctcccactccctcctctcctctctccctccccaaacacactttaacctcatatgcggtgtcccttacactgccctccctatagccacctccatctctctcgacacctccatccccatgctcatgcgccgcaaagaagtgaaagactacggaactgccaagtccatcgaaggtgtttacgaaaagggtcaagcttgtttggtggtggaagacctcgtaac

SEQ ID NO: 25648 - DNA, 411 bp, Gossypium hirsutum
  Clone ID: LIB3272-053-P1-K1-A11
cgcctagtgcatttaccttagcggttcggatggatacaacacgtaccacgtggctattacaagggtcaggggaggccaacagggtgaacgatgatacagagaacaccagatggtgtatagtggctgacgagaacctggatgttggctgatgccggggggcaggtagactggcaaagtaacactgacaacacagctgaggtagggccccaaatgcgcaagtaatggtaacatgatgttacaccatttcaatggcacgttgatacggacaagttgtgatcattcaagtgccacaatctgaaggggctggtttgttatagcctgagagcaacagaaattgtgagcccggctaagctcaagaaaatggcaacggggcctatatctaggtgatagagcctaaacaggtgggtttgc

SEQ ID NO: 25649 - DNA, 420 bp, Gossypium hirsutum
  Clone ID: LIB3272-053-P1-K1-A12
aaaattattatttcaatccaaaaaatatccccaaaacctccccccatccccaccttcactccccataatcggccacctccacctccttaaaactcctatccaccgtttctaccaccatctttctcaaaaatacggccctgtcttctccctccgccttggatctcggctctttgtggtggtttcgtcttcagccgttgccgaggaatgcttcaccgtaaacgacatagttttagccaaccgtcccaagttgatcgcagggaagtacctcggctacaactacaccacagtttccacctcgtcttacggtgaccattggcgcaacttacgtcgcatcggcgctattgaaatcttctcctcgagtcgtctcaacgcctttgccgctgttcggaaagacgaggtccggcggttgttggtgagttt

SEQ ID NO: 25650 - DNA, 429 bp, Gossypium hirsutum
  Clone ID: LIB3272-053-P1-K1-A2
agctcacaagaaatatgcatttgagtcccacatttaccagaggatgttcagtgggtttcaacaggagaacttctccattaaattggataatgttacagtcaataaagagagcttcttccagcaatatctggctctgagggagatggatccattggacatgttgggccagaatcctgattccttattcgggaaattttcccagagcaagtacctgatggttgttcatccaaagatggaagcttcattctttggaaatttagaccagcgtaattatgtaacaggaggtgggcatcctaggactccattttaccaagcctttctaaaattggctaaatctatttggcttttgcatcggctggcttactcattcaaccctaacgtgaaagtctttcaagttaaaaggggaagtgaatactcagaggtttatat

SEQ ID NO: 25651 - DNA, 355 bp, Gossypium hirsutum
  Clone ID: LIB3272-053-P1-K1-A3
caactagccaacgacaaacctttcattattacacacctgtttccattacttctctgaccaaaactccgcctctgacaccacctgccgccaccaatgtccatcgccgcctgccttctcaccccttccccactttcctctcctagttcccttaccatcacccctaaattccccaccactttccctctccacctccacctccgcctttcctcctccgccacctgtctccgtcacagccgatcttccccgttcttaaccttctgcgccggcggcgatggtggcgatattaacagcagcaacaacaactcgggtggcgggggtggaaacgatcatgatggaaaacacacgggtggtgatg

SEQ ID NO: 25652 - DNA, 423 bp, Gossypium hirsutum
  Clone ID: LIB3272-053-P1-K1-A4
gaaatatttacggagttctaccgccatggggagaagacctgcagggtgttatcgtcagataaaaaacaaaccttacccaaagtcacgttattgtcgtggtgttcctgatcccaagattaggatttatgatgtgggaatgaaaaagaagggtgtggatgagttccctttctgtgttcacttggtctcttgggagaaggaaaatgtctctagtgaagctctggaagctgctcgtattgcttgcaacaagtatatggccaagtatgctgggaaggatgccttccacctgcgagtccgtgttcacccattccatgtcttgcgtatcaacaaaatgctttcatgtgctggagctgataggctccaaactggtatgcgaggtgcttttggcaagcctcagggaacatgtgctagagtagccattggtca

SEQ ID NO: 25653 - DNA, 432 bp, Gossypium hirsutum
  Clone ID: LIB3272-053-P1-K1-A5
gtccaacgcgcttgttcatctgtggagtttagattccttgtttgcttctattgaaagctcaactacacacagtacgcatctccctttctggttctggtgtctatgctattttctctgagaagctgaaaaagggcacgaatcggtggagttgcgcaggcgctcagcaattcttccattcagaaacaaagtactattgcctggcgcctctattcgaatctgctagcacttaacagagcattgtaaaattcatggagcaagagttatggcaacgagaggagaaaggattaataggaattctcccggatcaagaggctgctgagacgacctacatcgattccatgttatctcaaggcggcaccagtgaatcatgtgagcgaagctcgaacgtcacgttagcacatctgatgctcacacggttgatcggaaaaaccc

SEQ ID NO: 25654 - DNA, 433 bp, Gossypium hirsutum
  Clone ID: LIB3272-053-P1-K1-A7
cttagtttctgcttttttctttaaaacaataaagatcccttagttccttctttctttcttcgccttttcctccaacaggagttatgattcggctgtttaaagtaaaggaaaagcagagagaacttgctgaaaatgcaaatgggggagctcctaccaaaaagcaaagtccaggagagttgcgtttgcacaaagatatttctgagcttaacttacccaaatcttgtgctataacatttccaaatggaaaggataacctgatgaattttgaggtttcaattcgacccgatgaaggatattatttctgtggcacatttttattctcctttcaagtttctcccgtctatccgcatgaggcacccaaagttaagtgccagaccaaggtctaccatccaaatattgatttggaaggaaatgttcgccttaacatcttacg

SEQ ID NO: 25655 - DNA, 320 bp, Gossypium hirsutum
  Clone ID: LIB3272-053-P1-K1-A8
tcgttattaatcggcggaagcagatagcctctagccatgactttcaagcgtaggaatggtggccgcaacaagcatggccgtggccatgtcaaattcatccgctgttctaactgtggcaaatgctgccccaaggataagtcaattaagaggtttcttgtgaggaacattgtggaacaagctgctgttagagatgtccaagaagcctgcgtttatgacacttatactttgcctaagctgtatgttaagatgcaatactgtgtctcgtgtgcgatccactcccacgttgggagagtccgatcccgcaccgataggaggaaacg

SEQ ID NO: 25656 - DNA, 89 bp, Gossypium hirsutum
  Clone ID: LIB3272-053-P1-K1-B1
aaaaacaacccttgtaaaaccaaggcttaaatttgggaacctacccaggtggcctggccattaaattcagaaaggttgtcttttaactc

SEQ ID NO: 25657 - DNA, 341 bp, Gossypium hirsutum
  Clone ID: LIB3272-053-P1-K1-B11
aaaaaaattagtgaattttgagtggattgttcttggatccaattttttggagattacagagaaaaaaagattgatttgcaaatacacaatacgaataatcgcgatgggtttcaagatatttgtggtggcgatgatggtgggttccatcgcagcggctcagatttcattagcatccaccgtgcctgcttttctatgggctcctggtttctctagcgttgaatcgaaggaatctgtaaattatcagatcaagtctccaaaggatctagctaactctgttctctctcaagggggatggtctgacttactgtgctccgagaggaaaaatggccgccctgttgatc

SEQ ID NO: 25658 - DNA, 284 bp, Gossypium hirsutum
  Clone ID: LIB3272-053-P1-K1-B12
atgagatttatctattctcaagaaaaaggatatcgctagaataaaatatcatagcggggatatttaaagaggcggacggcccggatcatcatgacgcacacttcaagagcaaaagctgcattggcataaaaaccaaatgatgcttgattattctacagtgggtacacctgaatataatgacgcacaggtttccctgtagaaaggatatggtacggaatgcgataggtgcactctggaagctatcatgtatgaaatgcttgatgatatgcacccttttattcaga

SEQ ID NO: 25659 - DNA, 363 bp, Gossypium hirsutum
  Clone ID: LIB3272-053-P1-K1-B2
ccgtcactagcggcgccgtcacaaaatgtcgtcaacggagtctctcatcctccaactccatgaaatctctgccgttaaattcggtaacttcaagctgaaatctgggatcttctcccctatctacatagacctccgtctcatcgtctcttacccttccctcctccaccaaatctcccactccctcctctcctctctccctccccaaacacactttaacctcatatgcggtgtcccttacactgccctccctatagccacctccatctctctcgacacctccatccccatgctcatgcgccgcaaagaagtgaaagactacggaactgccaagtccatcgaaagtgtttacgaaaagggtcaagc

SEQ ID NO: 25660 - DNA, 197 bp, Gossypium hirsutum
  Clone ID: LIB3272-053-P1-K1-B3
gttgtttttgaatttaggagcattgctcacttcactaggctgccctgaatgttaccggcacccatctccgccggcgaaatgtcctccgccagactatccgcctaaacataatcatcctccattggtaaagccaccttataaccttaaccaaccaaaccttattcctccaaggcaacttaagcttcgggggttaaccc

SEQ ID NO: 25661 - DNA, 394 bp, Gossypium hirsutum
  Clone ID: LIB3272-053-P1-K1-B4
gcgtccggttctaactcaacattcccatttcaaatctcaagctcccaaggtaattatgcggttcagaaacatattaattgaccgacccgaataggctactaacccggatgctctaaaggaagttttggctgagttaatctaaaccttgatcttcgttttcgctggatcggcctcaggaatgctttttaccaagttgaccgacaccggagcaccacccccgcccggtctcgtagccgccgttctagctaatggcttcggtcttttcgtcgttgtctccgtgggcgccaacatctcaggtggccacgtgaacccggccgtcaccttcggtgctttcgttggcggaacatcactcttttgcgcggcattctttactggatcgcccaactcctaggct

SEQ ID NO: 25662 - DNA, 429 bp, Gossypium hirsutum
  Clone ID: LIB3272-053-P1-K1-B5
caggaaaacaagaaaagcagagccgcatcactttttgctagctaagctactgggggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctgaccctgttacggggtattaccggccggagaactgtggggct

SEQ ID NO: 25663 - DNA, 426 bp, Gossypium hirsutum
  Clone ID: LIB3272-053-P1-K1-B6
atgcgaaagtagagaagttggatgtaatgcatggatgtacacaggcacaccttgcacttgcctgggttctccaccacggtgatgacgactctcctattccgggatcaactaaaaataaaaatttcgaccgcaacattgcacgagtgcatgtaaagctcacagaagactgattggtaagaagttgcatatgctacccaaatccatgaggttgcagggtgtactcatcctgacggtttacagcagtacacttggagatatggccatacaccaccaaagaagaggacctatgtttagaagcgacctttcatgggtgttgggatgaatggatttcccaggaaactgcgtgcattacaagatcgatgagttactaaagctttgcattgtcattaatggagggttcagtgtttatgacgtaggtgcgtcata

SEQ ID NO: 25664 - DNA, 348 bp, Gossypium hirsutum
  Clone ID: LIB3272-053-P1-K1-B7
gataatacccaacacccaacctaaaaacatgtatcagatttggaagctcatgctcttagtttcacttttaatttgccaccttctatccaaggtgccgggaacatcatcggagccaccaaagcactttgtgctggttcatgggtcttgccatggcgcttggtcatggtacaaggtggtgccactgctaaaatcaggtggccacaatgttaccgccttagacctgggtgggtcaggggttgatccacagcaagtcaacactctgagatcgatctctgattacataaagcccttgagggaattcatggcatcgttacccaatgaaaaaaagtggtgcttgttgtcacagtt

SEQ ID NO: 25665 - DNA, 365 bp, Gossypium hirsutum
  Clone ID: LIB3272-053-P1-K1-B8
ttttcaaaccctagcctgtatctgggagccctttccaatggcttcgcgtcgactcctctcttctctcctccgctccacttctcgccgatctctctccaaatctcccagccctacccctcgcctcccttccccttcccccacgcgccgcccttttccttgcccttactttctctcacgcgatgctgagtactctacatctgcggctgctgccgcttctgctccatcgcagcctcctcccgctaagaagggcggaaaaggtaagatcactgatgagttcactggtgctggagccatcggtcaggtttgtcaagtgatcggtgccgtcgtcgatgttagattcgatgaaagtttgcctccgattttga

SEQ ID NO: 25666 - DNA, 314 bp, Gossypium hirsutum
  Clone ID: LIB3272-053-P1-K1-B9
aagcaaggccacggaagaagaaaaaagggattcgcttaacagccaacattttgtttccttctgctactggctagggtttaaatcaggggttttccttcttcttctcactgcttcaccactattccaccatcaacaaccaatggatagataccagaaagtagagaagccaaagcctgaatcacccattaacgagaatgagatccgaatcacttcccaaggtgctattcggaactacatcaactatgctattgctcttcttcaggacaagcatgtgaaggaaattgtcttgaaagcaatgggacaggcaatcagta

SEQ ID NO: 25667 - DNA, 153 bp, Gossypium hirsutum
  Clone ID: LIB3272-053-P1-K1-C1
cgaccccgcctccgaatttttcttattcttcttctattggtcttgctccgcttgctctgattttcaggggaccttctctttctttctaggggccttccacagtcgaagaaactgagcagccaaaatggtgggaaaggtattcgcgaccccata

SEQ ID NO: 25668 - DNA, 428 bp, Gossypium hirsutum
  Clone ID: LIB3272-053-P1-K1-C10
ctcaaggttatttttcttttataactgttccaatccaaactcatagattcaatggccgaggatgacgttgtatctaaggatcgcaaaatcctggtggccgtcgacgaaggtgaggagagcacgaacgctctctcatggtgcctcaagaacgtgatttctcacacttcgaaagatacccttgtcctcctttacgctaaacctccacgagccgtatacacttccctagatggcacggggtatttgttttcttctgatattttggccaccatggacaagtacagcaacgatgtggcgggttgtgtcatcgagaaggccaaaaggatgtgcagagagcaaggtgatcctgaggttaaagtagaggtgataatagagagcggtgatccaagggacgtgatttgccaggttgccgacaagatcaatgctgatgt

SEQ ID NO: 25669 - DNA, 430 bp, Gossypium hirsutum
  Clone ID: LIB3272-053-P1-K1-C11
cccgaccagggtttactattatacaaaagtttggaggagaacttttcaatgcaagacaagatttttctcctttcaatgtggttgcctggcatggtaattatgtcccatataagtatgatcttagcaagttctgcccttacaatactgttttaatcgatcatggtgatccatcaataaatacagttctgacggcaccaactgataaactgggtgtggcattgcttgattttgtcattttccctccccgatggttggttgctgaacatacattcagacctccatattaccatcgcaattgcatgagtgaatttatgggcctaatatatggtggatatgaagcaaaagctgatggttttctgcccggtggtgctagccttcacagctgcatgactcctcatggtcctgacaccaagacatatgatgccactgt

SEQ ID NO: 25670 - DNA, 430 bp, Gossypium hirsutum
  Clone ID: LIB3272-053-P1-K1-C12
gcttccttcacgtagaaaaatcaactctccctttccctcacgaaacttcgatttctttttccccagcttcacttcctcgtaaaagtttcctttttgccgctccttccccctagggtttcgtatagtaaggaacgaggggatcgaacataatcaaatcgaatggattggggaaacctaacccgagaggatctgatcgacccgcttcgtgaagttgactggtcatcaccgccaccaacctttcccggattttttttttggttcaaccttccttgatcatatgccaaaatggaatagccgccttaaaggcaatctctactactaccgaaccaattatttcatcatggttgctgtcattcttggtttgggattcttgaggagaccggttgctattttatctgcgatgttaacagcacttagcattgcttttctg

SEQ ID NO: 25671 - DNA, 416 bp, Gossypium hirsutum
  Clone ID: LIB3272-053-P1-K1-C2
attttgtttttctgtccaaaaaaccctctccaataacaatctgtaaagcttccttcacgtagaaaaatcaactctccctttccctcacgaaacttcgatttctttctcctcagcttcacttcctcgtaaaagtttcctttttgccgctccttccccctagggtttcgtatagtaaggaacgaggggatcgaacataatcaaatcgaatggattggggaaacgtaaccgcagaggatctgatcgacgcgcttcgtgaagttgactggtcatcaccgccacgacctctccccgaattcttctctcgtttcaccttccctcgatcatatgccaaatggaatagccgccttaaatgcaatctctactactaccgaaccaattatttcatcatgattggtgtcattcttggtttgggattc

SEQ ID NO: 25672 - DNA, 433 bp, Gossypium hirsutum
  Clone ID: LIB3272-053-P1-K1-C3
gttttgaatctagggatttgcgggtggagaagacgagagctcatctctctgcttcaaagctcctgtccaggtagaattctcttcttcctttgcgttgtgttctttgttgttcagtcgccatggcttcaaagcggattttgaaggaactcaaggatttgcagaaagatccacccacttcttgcagtgctggtccagtagctgaagacatgtttcattggcaagcaacaatcatgggaccctcagattgcccttatgctggaggtgtgtttttagttaccatccatttccctccagattatcctttcaagcctcctaaggtcacgtttaggaccaaggtcttccatcctaacatcaacagcaatggaagcatttgtcttgatatcctcaaagaacaatggagccctgcactaaccattttcaaggttctgctctc

SEQ ID NO: 25673 - DNA, 403 bp, Gossypium hirsutum
  Clone ID: LIB3272-053-P1-K1-C4
ggggacaggagaggtagagaaatagtgtgatggcatccgggtggggaatcaacggtaacaaaggcaggtgctacgatttctgggtcgacttcagcgagtgcatgtcccgttgcagagaacccaaggactgtggtcttctccgtgaagattatctcgagtgcctccaccattctaaagagtttcaacgaaggaatcgaatttataaggaggagcaacgtaaattaagagctgccgcacgaaaagacaaggaaggcgaaaatggtgttcatcatcatgcatagtcataatttgtgatcctttaatttgccaataataataatgcgtggagattgttgtatttatgttgggattggatttttaactcttagctaaattaccttttggtttcctttcgttggaatgg

SEQ ID NO: 25674 - DNA, 237 bp, Gossypium hirsutum
  Clone ID: LIB3272-053-P1-K1-C5
atataacctgccactttagttgacgacaccaaaaggaaaaatatctgaacaattacaacctcgtccttgttgactcagttgacacggcttcttttgttgtcttgaagtcggcttgagttttcggaactcaaaacgtgcttggatctgacctggatgccaatgaaaatcagacactggataagagtgcaggcactcacccttgaatgggggcggggaacttggctggagccattgacg

SEQ ID NO: 25675 - DNA, 437 bp, Gossypium hirsutum
  Clone ID: LIB3272-053-P1-K1-C6
ccggattggaattcagacacagtgaacttcaacctttgctgtttcctgtttctcgagaaacaaacagagaagagaaaggatggtgctctcctcatctctgcattcgctttgcataatcccccatacctctcaatctaaaatcccaagtatcttcaacctcctaaagtctcctttatccaaaacccacctcaaattcaaccccattttcaaaccctcttccctttcccttttccctcaaccatccaagctcagaccaaaaacccaaaatttccgtacccccaccatccgctccctctttaccggtatcgtcgaagaaatgggtgaaatcaagcaactgggtatggccgatcacggcggattcgatctcaaaatacacgccaaaactgttatagaggatgtccacctcggtgacagcattgcggttaatggaacttgcc

SEQ ID NO: 25676 - DNA, 408 bp, Gossypium hirsutum
  Clone ID: LIB3272-053-P1-K1-C7
cttattcttcttctattggtcttgctccgcttgctctgattcccagaaaaccatcgctctctttcaaggtgcatgcaacagtcgaagaaactgagcagccaaaatggtgggaaaggaatgcgggaccaaatatgattgatattcattctacaaaagaatttatcagtgccttaagtgaagctggggatagattagttattgtagaattttatggaacttggtgtgcttcctgcagagcattatttcccaagctctgcagaacggcgcaagaacatccggaaattatattcctcaaagtaaattttgatgagaataaacctatgtgtaaaagtttgaatgttaaggtgcttccttatttccacttctatcgcggagcagacggacagctagagtcctttttttgttcac

SEQ ID NO: 25677 - DNA, 440 bp, Gossypium hirsutum
  unsure (1)..(440): unsure at all n locations
  Clone ID: LIB3272-053-P1-K1-D1
cgtccggttcactgttcctactcaactcgtttgattttgatcagaccgtgatcatgccgatcagaaacatagccgttggccggcctgaagaggnnatcatgagagccgtcatataacacaagtgtatggtttttatgattaatgcttgagaaaatattgtaagaccaacgtgtggaatgttttttactgacctttttgattatttaccaaacacatctcttattgttagttgcagcttttgtatctatcgaattctcgctttatgtttcgacacgttttacattatttgagcattggaccgtgtacaggaagttcctcatgaaggtccaatgtgtgatcttttgtgtactgattcttgtgaccgttaatttatgggggatctattatagtggagttatttatacattttgactaattattgcttacgtattttatcctta

SEQ ID NO: 25678 - DNA, 432 bp, Gossypium hirsutum
  Clone ID: LIB3272-053-P1-K1-D10
ctcaactccaccatcttcaccatttttctcacttttttgcccttttggtttcaccctcactgaccaatgggacaaaaatcgagaaacaaccgtctctttcactcctccattattcttctcctagtttctctctccgccgctttatcctctcctttccagctccaaaccctactcccccgccctctcccttcagcacccaccctctcatggcacgactccgaacccgaatctaattcccttcaagaaacctgccagctcgaccctcttagttccaacaccacattggaagtgcagctggaattgcaccatgtagacgctttatcttcggaagatactccggagctactcttcgacttacgactccaacgggacgcgctgcggtctggaactatatactctcttgtctccaaagctgttgcgcggaaccctcca

SEQ ID NO: 25679 - DNA, 374 bp, Gossypium hirsutum
  Clone ID: LIB3272-053-P1-K1-D11
attttctgctctttcaattttaagaccaaatcacgagcgactctcagactcagctgagttaagatcgctaaagcgatatggctttgcagctatgggaaacgttgaaggaggcgataacggcgtatacgggtctatctccggccacttttttcacggttctagctctgttatgggctgtttactatgtagcaacgggtctattcgggtcatccgatgaccatatccatcaacggtctacggctttcgaggagcagatggagccgctaccgccaccggttcagctcggcgagattaccgaggaggaacttaagcagtatgatgggtcggattcaaagaaaccactccttatggccatcaaggccagatctatgatg

SEQ ID NO: 25680 - DNA, 105 bp, Gossypium hirsutum
  unsure (1)..(105): unsure at all n locations
  Clone ID: LIB3272-053-P1-K1-D12
atagtgagtagatttataaagatggttcgagcagcaagaacaccggtccgattgttgtgaagaaacattggcaaaggttgtnnntnnnggatatgaaatagtaca

SEQ ID NO: 25681 - DNA, 417 bp, Gossypium hirsutum
  Clone ID: LIB3272-053-P1-K1-D2
ggaagctagcattgctgtaaaacaatggcggattaccattttgttaacatagatgtcgaaggagcttccactcaatgggatgatatccaaagaaagcttggtaatataccctcaaagccaccagttttcaagcctgacctttttgaacctgcacctgtcccggattccgtccctaaggacatgttttggatcgatgaaaagactgcagaataactcgaagaaatcgaagatgatctcgatgatgatagattcctcgaagaatacagaaagaagaggctggctgagatgcgggaagctgttaagatttcaaagtatggatcggctatgccaatcatcggatgcgattacgtacgggaggtttcgcatgctcctgaggatgactgggttgctgtcattccatacaaagaaggatctgtg

SEQ ID NO: 25682 - DNA, 280 bp, Gossypium hirsutum
  Clone ID: LIB3272-053-P1-K1-D3
gttagtccatcctaaaaaaccgggggaggccctcccgccggcccttccaccccgggctgggaagggtattcgggttaaattcccggacccggtccccgtcggttgacggcatcgttgggttgtccttagtcttttttcttttttcttataatgtgttattttttttttttattttttttatacttttttattgtgtattttttattcatattctttttatcttttatctattgtttttttttcttttttttttttttttttttttcttcctttttatttt

SEQ ID NO: 25683 - DNA, 437 bp, Gossypium hirsutum
  Clone ID: LIB3272-053-P1-K1-D4
attgtaatgagaaacttgaatcagatccatgggagctagttccatcaaatcatctcaaaagaacccatttttcacaccaaaaacacccataatttcccaagctccacccagatccatcttcatataatcccaatttccttttctattaaaaacccattttttcttcatctaaattaagacacccagatcctcaaaacccaaaaagaaaccatgaaaaaccaatcgaaaatgttcacgatcgggctagtatcagcctggtactcttccaacataggtgtcttgttgttaaacaagtatttactaagcaattacggtttcaaatacccaatcttcttaaccatgtgtcacatgacagcttgttctttgttaagctacatcgcaattgcatggatgaagatggttccaatgcagaccattcgatctagggttcagttttt

SEQ ID NO: 25684 - DNA, 389 bp, Gossypium hirsutum
  Clone ID: LIB3272-053-P1-K1-D5
cttaaactagaaacacgcaaagaaaaaacatggagcactttaatctacttttgtatcagaccttatccatacaaagtggatggaacattcgtatcgttcttttgatacgactctgctggagttatggcaaaggagcttggtggaggatccggttataattaatggctatgggtgcgtgaagcaaccgcatgtctgcactcgacaaactctaggaaggactgaggcataaaacctattggatgacctgaatgggatgcactgggatctgcagacgagcaggaaagagagccggatatgcattgttgctgtgcttgaggagcaagaacatcagatgctccctgactggaaagcccaactgactgaaccttctaagcatcttcattgaacaa

SEQ ID NO: 25685 - DNA, 390 bp, Gossypium hirsutum
  Clone ID: LIB3272-053-P1-K1-D6
cgaacattttcacagcttaaaacacaatatgactaaggatattgagaccacggcggagcaaggcggcggagcggagttctcagcgaaggactaccaggacccaccaccggcaccgttgattgacttggaagaactcaccaaatggtcgctttatagggcggcgatcgctgagttcattgccacccttcttttcttgtatgtcacggtgttgactgtgatcgggtataaagtccaaaccgacccggtaaagaatactgttgacccggattgtggtggtgttggtatacttggtattgcttgggcttttggtggcaatgatctttatccttgttactgcactgctgtatctctgaggacacataaccccgccgtgacgttggactgtcgtgg

SEQ ID NO: 25686 - DNA, 430 bp, Gossypium hirsutum
  Clone ID: LIB3272-053-P1-K1-D7
cactctcccaccccgaccgcttgattttgatcagacggtaatcatgccgatcagaaacatagccgttggccggcctgaagaagctactcatccagatgctcttaaagcagctttagctgagttcatatcaacgttaatcttcgtttttgctgggatctggttcaggcatggcttttaataagctgaccgacggcggtgcaacaactccggctggtctcgttgccgcctctctagctcacggatttgcgcttttcgtcgctgtctcagtcggtgctaacatctccggtggccatgtgaatcccgccgttacattcggtgctttcgttggcgggaacattactcttttacgtggtatcctttattggattgctcaactccttggctcaaccgtcgcttgcctgttacttaagttcgccactagtggcctggg

SEQ ID NO: 25687 - DNA, 355 bp, Gossypium hirsutum
  Clone ID: LIB3272-053-P1-K1-D8
cttatacagttatacttatgaagttgagcagtaaaagagaaaaatggaaaaaggagggacaattgcagtggagaaaagaatgagaaacggttaaaagctttgcacgacattttttctattatttattcgcatctgatttgtgatatgaactatgagtttatgagttctttctatcaaaaagatctgtaatgagacttgagtttagtatacatgcgactacaagcaaggtgaatggctgcttgtctagacctcaatctcaatcagtgcaggacgtcgcttccagtaaatgcattggttccaatttccacggttatagaagctgataatattctcctttcaccggacgcgacatttt

SEQ ID NO: 25688 - DNA, 374 bp, Gossypium hirsutum
  Clone ID: LIB3272-053-P1-K1-E1
aatcattaacatttcacccaaaaaacatacacccatttgcgttttaagcttcagaatgatacagaaaatatccattatttttcatgatccaaatgcaaacccgtttcttgcgcccataaaaaaccccgaaaatgatggagacggtgccggaggggcggtttcagatcaagagattggttgcggcgatccttccttcatatcgaactctctttattctgttatggatcgtggcttcaggggcggctattatatggcagcgacaaaattattggggcggcgatttcaggttcggtaaaaaccgcgttgagtcggcctatgccaaagatgcgggctcttgcgtttaattaggctgatttctgcgggggtggggatgg

SEQ ID NO: 25689 - DNA, 433 bp, Gossypium hirsutum
  Clone ID: LIB3272-053-P1-K1-E10
gcagtctctcccgctccttctcgctgcgatttcgtcttcaagatctcagttctcaaatcgtagcgctcttttctatcaagccatggctctgatcttgcatgcaggaaaaacaaacaaaaatgcctttaaggcactcattgctgcagaatatagtggtgtgcaggtcaaaatggttgagaattttgagatgggtgtgtcaaataagactcctgagttcatcaagatgaaccctttggggaaggttcctgtgttggaaacacctgagggtccggtatttgagagcaatgccattgctcgttatgttgctcgctcaaaggttaacaaccctatatgtggttctacattgattgattatggtcatatcgagcaatggattgattttgcagccttggaaattgatgctaatattgccaaatggttgtatccaagactt

SEQ ID NO: 25690 - DNA, 326 bp, Gossypium hirsutum
  Clone ID: LIB3272-053-P1-K1-E11
cgacactccaaattttcagatttcctttcctttctcaccggaaaatgaaaaacatgggcgactttccgacgtttctagtcgtcgcacttttgatcttcagttgtctttcctatgttagatccgacgcttccgatcaccgttacaaggacggtgacgctgtacctctttacgccaataaggttggcccctttcacaaccccagtgaaacctatcgctacttcgatctacccttctgttctccagatcatgtaacggagaagagagaagctttaggtgaggttttgaatggagatcgactcgtgagtgctccttataaattgaatttt

SEQ ID NO: 25691 - DNA, 435 bp, Gossypium hirsutum
  Clone ID: LIB3272-053-P1-K1-E12
cccatagctccttcgatgagattgaggagattataatttcgttttatctcttccatctcttttcttttcttttattaataccctttttgttgtttaattttgtttttattttgtttttagttctctcttacccatccagtgatcctcagatttctgggtttgcattaaattttgcttctctgtaagaagatttctcagctttcagagaatttcgaaacaacaatgctgacgtgcatagctcgttccaagctacccggtgatgactcggtgagtcaacaagaggaaatggactcttccactactcctaacactaagcacaaccaagccatcaaatccctcacttcgcagttgaaggacatggcgctaaaggcgtcggtggcgtacaggcactgtaacccctgcacggcgcacagtcggttgaggaacatgggcgag

SEQ ID NO: 25692 - DNA, 296 bp, Gossypium hirsutum
  Clone ID: LIB3272-053-P1-K1-E2
cttcaattcctcatttcaagggagagagtgtatcagtgtttcttccccttttttaccttaaatttttttccgccatggttcttcttccgtcgagaaaaccgccgccggccgtgagtacaaggccaaagacatgtctcaggctgacttcggtcgtctcgagatcgagttagctgaggttgaaaggcctggttaaagggctggtagaaccgagttcggccctgcccaacctttcaagggagccaaatttactggttcttttaacatgaccatccaacccgccgttcttattgaaaccc

SEQ ID NO: 25693 - DNA, 302 bp, Gossypium hirsutum
  unsure (1)..(302): unsure at all n locations
  Clone ID: LIB3272-053-P1-K1-E3
cgtcctngctttggaagggcatgganncttcatagctacctanntcctgtttctaaggctcttgtcantctccgtccacnncaaagctttgtgactctcttggcggcnncctcagcnncagaatgacnntcggacnnctttnntggtcatcnnccaatctaaaatggcaaatggttcaaccatttcaaaacccacccaaaccctggactcnaatcgttcaacaaacagtcatgaacanntgtgcatcaaaagggacccagcaaggggtcatagtacccttgtcgagcccttgtaagcccaaa

SEQ ID NO: 25694 - DNA, 439 bp, Gossypium hirsutum
  Clone ID: LIB3272-053-P1-K1-E4
cccacgcgtccgctcactcaacattcccatttccaatctccgctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaaccgtcgcttgcctgttgcttaagttcgctaccggcgacct

SEQ ID NO: 25695 - DNA, 440 bp, Gossypium hirsutum
  Clone ID: LIB3272-053-P1-K1-E5
ctctttctctattctctttggcttatctatcgctttgatttcgcgtccttactgtgcactcgatggcaaatcgatggttgaggcctgaggtgtatccgctgttcgcggccgtaggtgttgctgtcggaatctgcggttttcagttggtgcgaaatatctgcatcaaccctgaagtcagggtaaccaaggagaacagggctgctggggtcttggacaactttgctgagggagaaaaatattctgaacatttcttgagaaaatatgtccgcaacaagacgccagagatcatgcccagtatcaacagcttcttcactgacccaaagtgaggctttactcttgctttatgctgaaactaaaataaaaaaatcgaagaactaactctcattcaatcaataccaagttttgccctttctttctgctgactgtgatgcaaatatgtg

SEQ ID NO: 25696 - DNA, 401 bp, Gossypium hirsutum
  Clone ID: LIB3272-053-P1-K1-E6
cccatctctcctctcatacttcactctaacgttccctttgaggttttaggaaaacagcagagaaattaaggaatggagaccttcctatttacctcggagtctgtgaacgagggacatcccgacaagctgtgtgatcagatctctgatgcagtcctcgatgcctgtttggcacaggatcctgagagcaaggtggcttgcgagacctgcagcaagacaaacatggtgatggtgtttggtgagatcactaccaaagccgacgtatactacgagaagattgtgcgtgacacctgccgtggcatcggtttcacatctgacgatgtgggtctggatgccgacaactgcaaagtgctggttaacatagagcaacaaagccctgatattgcccaaggtgtccatggcca

SEQ ID NO: 25697 - DNA, 431 bp, Gossypium hirsutum
  Clone ID: LIB3272-053-P1-K1-E7
caaatacccattttcaccaccatcaaaccacatcccacagacatgggtgcccacgaagaagaagccggaggtgaagagtacttgtttaagatcgtgctgatcggtgactcagctgtgggaaaatcgaaccttttgtcacgttttgctaggaacgagttcgacaataactcaaaggcaactattggagtagagttccaaacgcaatgcgtggaaattgatgggaaagaagttaaagcacagatctgggacactgctggtcaagaaaggtttcgagctgttacttctgcttactatagaggagctgttggtgctcttattgtttatgatattactaggaggagtagctttgacagcattaaacgttggcttgatgaacttaccactcattgtgaaactacattgacaagaatgctggtggggaacaaatgtga

SEQ ID NO: 25698 - DNA, 313 bp, Gossypium hirsutum
  Clone ID: LIB3272-053-P1-K1-E8
atctcgctgaatttcttagttggtggttggttggttggttggtggtgggggtggaggaggatgtggcctgcttaatgtctggcatcgggtggggccgcatgcgcctgtgatgcgtgccaaccgtggtttcggggattagtcggagatctgccagggtcgcttattggggaccttttggtttttcttttggtggttcggggattccttgggagggttgcgcccctttgatggagaagcttccttggatcaaccatttccataaaacacccggccgggaatggtttggaaccgattccatgcttggggttaactt

SEQ ID NO: 25699 - DNA, 163 bp, Gossypium hirsutum
  Clone ID: LIB3272-053-P1-K1-E9
atcttgctaaatttctcagatggtgatgggtcgaaagattgttgttgcggtggaagaggatgctttctagctgacgcctcacatgcacagggtcaggaagaccaaggtcatgctatgaactcgtacaaggattcttttcctcaggctgaagacattatcaagg

SEQ ID NO: 25700 - DNA, 431 bp, Gossypium hirsutum
  Clone ID: LIB3272-053-P1-K1-F1
cttgggttgagtgtagagatgaggaaaatcatgggtgccaaagttcttttcttctttgctttgctttccttttcagctggctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaagg

SEQ ID NO: 25701 - DNA, 441 bp, Gossypium hirsutum
  Clone ID: LIB3272-053-P1-K1-F10
ttttctttcaactcaaagtcccaagtagtattagaatcatgggtgttgtcacttataactatgactctacctcccctgtcgctcccgccaggcttttcaaggccttcgttcttgaagctgacaaggtctggcccatagctgcccctcatgcaatcaagagtattgaggttgaagctaatcctggccctggatgtatcgtaaagatcaactttgttgaaggccttccattccaatatatgaagcaccagattggaggacatgatgaaaacaaattttcatacagttacaatttgattgaaggtgggcctttggggaacaagcttgagaaaatcaactacgagaataagtttgaggcagctgtaggtggaggaagtgtttgcaagagctcgatgaaattttacacttttggtgactatgtaatcactgaagatgaaatcaagg

SEQ ID NO: 25702 - DNA, 442 bp, Gossypium hirsutum
  Clone ID: LIB3272-053-P1-K1-F11
gccaacccatgatgagatagactttgaattcttagggaatctgagcggtgacccttacattttacacaccaatgtctttacacaaggcaaaggcaacagagaacaacagttctatctttggtttgaccctacaagaaacttccacacctattccatcatttggaaaccccaacacatcattttcttggtggataacacccccattagagtcttcaaaaatgctgaatccattggtgtaccattccccaagagccaacccatgaggatttactctagtttatggaatgctgatgattgggccacaaggggtggattagtgaaaactgattgggcaaaagcacctttcacagcttattacaggaacttcaatgccaatgcttgtgtctggtcaggaacaagttcatcatgtgctaaaactaactcggtctccgccggtgcatgg

SEQ ID NO: 25703 - DNA, 432 bp, Gossypium hirsutum
  Clone ID: LIB3272-053-P1-K1-F3
atacccccctcactattgaagaatttcatatgcctcgtcctaaagctggagaagttcttattaaaaccaaggcctgcggagtatgccactctgatcttcatgttataaaaggcgaaataccattttctagtccttgtgttatcgggcacgaggtaactggggaaatcgttgaacatgggccacttaccgatcgcaaaatcatcgaaagatttccaattggatctcaagtggtgggagcttttatcatgccttgtggtaactgtttcttctgttctaagggccatgatgatttatgtgaagacttctttgcctataatcgggcgaaggggaccctttatgatggggaaacacggcttttcctccgcaacagtggaaaaccggtatacatgtatagcatgggaggccttgctgaatactgtgtcattccagcac

SEQ ID NO: 25704 - DNA, 416 bp, Gossypium hirsutum
  Clone ID: LIB3272-053-P1-K1-F4
agaagaaattgcatatatatagccctcagcaaacaaggatgaaaacagtaatgggatcccatagatcttcctcaacaagtattacaaatataacaagccaatgatgcaaaatcatagatagattcaacaaaatttggctcttatgttattagggacgtaacatacttaaaagataagataccctctaagtgcatttagccatgtaggcttcccatccttgaagacggtactcacgagctgcctcagctgggtttgctgccttaatgattccccgaccaacgattattatgtcgctacccctatcaaagatgactgaatacggagtgttgtattgttggccgagggcatcgccaccctttaccatttgaactccaggggttgcctgaatgaatgctggatttacaggtgcaccgggc

SEQ ID NO: 25705 - DNA, 446 bp, Gossypium hirsutum
  Clone ID: LIB3272-053-P1-K1-F5
gcgggattacccgctgagtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaaaaggactttcttccttcaacccttctcatctcatttctcatactttccattttttacttttttcggccaaaatgcctggaaaggaaacttt

SEQ ID NO: 25706 - DNA, 427 bp, Gossypium hirsutum
  Clone ID: LIB3272-053-P1-K1-F6
tgataaaaacaaaatattttctcggaaaccaaacagtgtttgctttgatagtcaaatttcgaggtttagaaacgctgggctcacatttacgttgaaagctgtccagtctgatcccattcttgaatccaagtctcctgcaacttccaaatctcttgataggctaagattatttgttggtctgcctctagatgcggtttccgatggcaattcggtaaaccatgcccgggcaattggggcgggactgaaagctttgaaacttttgggtgtggaaggtgttgaattgcctgtctggtggggagtggtcgaaaatgagatggggaagtatgactggtcaggctatcttgctgttgctgagatggttcaaaaagcaggtctgaagcttcacgtatcgctctgcttccacgcttcgagtcaaccgagaattccg

SEQ ID NO: 25707 - DNA, 426 bp, Gossypium hirsutum
  Clone ID: LIB3272-053-P1-K1-F8
ctgggtctctctgtgtactgtcttccccttttccatttctcgtaaacaaagtgcataacattcgtctctcagatcctttcctcttagatcatcaaatccattcctttttttcaccaaaacatgagggaaatcataagcattcatataggtcaagctggtattcaagtcggtaactcatgttgggagctttactgccttgaacatgaaatccaacccgatggaatgatgcccagtgacacctctgtaggtgtagcaaatgatgctttcaacactttctttagtgaaactggttcagggaaacatgttcctagagctgtgtttgtggatctggaacctactgtgatcgatgaagttaggactgggacttaccgacaacttttccaccctgaacagcttatttctggcaaagaagatgctgccaataac

SEQ ID NO: 25708 - DNA, 405 bp, Gossypium hirsutum
  Clone ID: LIB3272-053-P1-K1-F9
cttcactcttctctcaccatgtcattgctgtctttctcctttttgttgctgtttacttttagtgccaaagctattgttcctccatctgaaacttttaggtttgtcaacgacggagaatttgggccgtatgttgttgaatatggtgcaaattaccgtgtcataagcatagctaatgcccccttccagcttgcgttttataacaccacctctaatgccttcacccttgcgttacgcatggctacaacgcgttccgagtcgctcttccgatgggtttgggaggccaacagggggaaccccgttcgcgagaatgccacgttctctctcgggactgacgggaaccttgtcttggctgatgccgatggtcggattgcttggcaaagtaacactgccaacaaaggtgtagta

SEQ ID NO: 25709 - DNA, 436 bp, Gossypium hirsutum
  Clone ID: LIB3272-053-P1-K1-G11
cacttcttctcttatttgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaagagctcaatgaaattctacactataggcgatattgttatcactga

SEQ ID NO: 25710 - DNA, 405 bp, Gossypium hirsutum
  Clone ID: LIB3272-053-P1-K1-G12
aaaaagaaaaatggcgtctttggctcaacagttcacaggtctaagatgtccaccactctcctcatctcggttttctgtgaaaccaaagcaaacccagaaagtgggcgcttttgcttctcctatagtttcagccgtggctgtctcaaatgcacagaccaaagataggcttgaactcaagaagatgttcgtggatgcttacgaacgctgtcgaactgctcctatggaaggcgtttcttttactgttgaggattttcaaaatgctctggagaaatatgactttgattctgagcttggaaccaaggttaaaggaacagttttctgcacagatggcagtggggcattggttgatattactgccaaatcttctgcatatctaccggtccatgaggccagcattcacaaaat

SEQ ID NO: 25711 - DNA, 387 bp, Gossypium hirsutum
  Clone ID: LIB3272-053-P1-K1-G2
aaagagcaggaaaacaagaaaagcagagccgcatcactttttgctagctaagctactgtgggagttattgttcttcagaacagcttctgcagtagctaataatatcgttatatattatataaattttatacatcctttttaccctacaactccatataagcaagtaaaaataaatatggctcgctctgtttcttcctttaagctccttggtgcttctatttttgatggtctttatgtctccatatcaaggagaggttactcgggtgcaccgccggcggcagtgacggctagctttggtaggcctggggcgatggggaaagtggaacgaagagatgcgatgaaagagtcgtcgtcgtcggagacaagggcttattcttcaacttgggc

SEQ ID NO: 25712 - DNA, 428 bp, Gossypium hirsutum
  Clone ID: LIB3272-053-P1-K1-G3
cttaaaccctagcagcttcattcgtttcttgctgtttctctcacaaatttctttgtcctttttctcttcttaaagttacattagcatattatggcattttctagcaaacttggaagccttctgaggttaaatgggcaaatcccagctacatccattcttagctctattcactgcatgtccacatcaaccaaaaagctttttattggaggcctttcatatggaactgatgatcaaactctcaaggaagcattttccgggtttggtgatgtgacagaagctaagattatcatcgatagagacactgggaggtctaggggcttcggttttgtaaactttgctgatgatgaatctgccagcaatgccttgtcagccatggatggtcaggaactcaatggccgaaatattcgagtaagttatgccaatgaaag

SEQ ID NO: 25713 - DNA, 441 bp, Gossypium hirsutum
  Clone ID: LIB3272-053-P1-K1-G4
aaacaaagcagttgaacccaaaaatacatttataatggtgaagccacaaaagccgccatctggtcgtacaaatctagcttcgtgtattgtagcaacggttttcttgatcttccttgtaataatagttcttatcgtttacttcaccgttttcaaacctcaagacccgaagatctccgtcaacaccgtgcagctcccgtcgttctccgtcggtaacaacaccgtcagcttcactttctcccaatacgtcaccgttagaaacccaaaccgggccgttttctctcactacgacagctccatccagctgctttattcgggctctcaagtcgggttcatgtttatacccgcggagaagatcgaagcgggtcggacccagtacatggctgctactttcgccggtcagtcttttccgttagcgccaacgaatgaggcatcggcggcgac

SEQ ID NO: 25714 - DNA, 412 bp, Gossypium hirsutum
  Clone ID: LIB3272-053-P1-K1-G5
tgcatatataaatagcgacgcgaaaaatagaattagcgacccaaaaagaaaaacaagaaaagagcttttgcgggaatggtgctgcagagattagagatgtgcgtggagatggtgaaactagttataaagtttgtcatcgttgtggctgaagctgttgggattgtcattcaccaaaatgatagtaaccggcccgtcataatgtcgatgcctatccgctctcatgcagctccttcggttccatttgttgggtttcttccttaaatttagttttttttggaataagttctgggtttttttgcttctatgcgataaacaaacagatgattccttcttaagtatgaaaactttgaggttcgcaccttttctttttttctttttccctgtggttgtaattcaatttgagtgtatatgg

SEQ ID NO: 25715 - DNA, 361 bp, Gossypium hirsutum
  Clone ID: LIB3272-053-P1-K1-G6
gtcgcctctctttctccttcttcttcttcattctgttggctgctgctgctgctttggtggcgtgatttagaagccacaactcaatttcatataaagaaaaaaaaagtgagatggatccagacgcagtagccaaggccttcgtcgagcactactactccacattcgatgccaaccgggccggtttagccaatctctaccaggaaggttccatgttgaccttcgaaggtcaaaagatccagggctctcagagcatcgtcgttaaactcaccagccttcctttccagcagtgcaagcacaacatcaccaccgatggacgccagcctttcggcttcggcagtatgctattgtttgatagtgctga

SEQ ID NO: 25716 - DNA, 344 bp, Gossypium hirsutum
  Clone ID: LIB3272-053-P1-K1-G7
cacatactctttttaaccatcctcaaaccatatgccacatgcctgggtgcccgcgaaggaaaaacccggggttgagagttcttgatgacgatcgagctgatcggggtctcacttgtgggaaagtcgaaccttttgtcacgttctgctaggaactacttcaccagtaactaagaggcatctatttgtgtatagctcctaacgcagcgctttgaaatggatgggaacgaggttaacgcacagacatgatacactggtgactaagagaggataagagctgttacttttgattactatttgggagccgttggggctcattattgttaatgatatgactaggaggggta

SEQ ID NO: 25717 - DNA, 431 bp, Gossypium hirsutum
  Clone ID: LIB3272-053-P1-K1-G8
tgaaattcaaaaaatacccccagattttgattttggggattattatcaacaaagttcaattcaaaatcaaaacagcttctttcagatcctcacttcactcccccccccccacaaatcaatcagataatccttagaatgcagaacagtgaaggcagctgtttatcttacatggcggcgtggttgggaagcagcgtagcccaagctttcttcgcgtctctcgagcgttgctcttgcattaacctttccacctccgatgatgccgatgattctgaggctcatgatctccctctcatgttcactaatcgttcctccatctctccatcatcagtcacctctatccctaacaacaacaacactccttcaaacgacgtcgttaatctccctgtttaggtcatggatcgcgtattgtttctagggtttcgaattttttg

SEQ ID NO: 25718 - DNA, 93 bp, Gossypium hirsutum
  Clone ID: LIB3272-053-P1-K1-G9
gagttatttggcttggggtctctctttgttttgtttttggatttccaatggaacggctgagaactaatgaataaaaaggtagtttcttgccat

SEQ ID NO: 25719 - DNA, 293 bp, Gossypium hirsutum
  Clone ID: LIB3272-053-P1-K1-H1
aaattcaaatcccttgattcctttttgtcaaccaagcatcccacccggactgttagttcgccgtttcatcaacttcccaaccttccctttttctttaatttcctaccccaattttcgccacaaatctaatccaaaatgagctggtggtgggctggtgccattggggctgctaagaagaaatttgaggaagatgaagcaccaagaagcttccagagcgttgggctgatcattggagtcaccggcatagtcggcaatagcttggctgaaatcctcccgttatccgacacccccgg

SEQ ID NO: 25720 - DNA, 390 bp, Gossypium hirsutum
  Clone ID: LIB3272-053-P1-K1-H11
ggaaaaagaaaaaaagtcaactttttttccatgttgctttttaatttgagtttggttttatggttaaagtgaaaaggaaaggaagatttagttttcacggaaaaaagtgtggattcggttcagttcagtagactgtgatcggatccaccggaggttcatgttctgctgtgattggaatcaattggactgcaatttgtaatgcaatctgttgacgtgagtaaggaaaagaatacgaatttgaaacgatcaagatcactattcgtgcacgatatgcccgtgactgacagcactgctgcgcgaacccttgaccattattatattataactgttgaagatatagttcaatcacctttacctgtatatgtagcacctacatctgttagttttagt

SEQ ID NO: 25721 - DNA, 427 bp, Gossypium hirsutum
  unsure (1)..(427): unsure at all n locations
  Clone ID: LIB3272-053-P1-K1-H12
aaaatatattcctagtgtcggtgacctctgtccttgcaagtagttaccagttaaaattttttttacgactgtccgatgagaacacttcttttgctgctttggaaccagatccagccgctagcattttgaaccctgcatttctcttttaacacatccatcgttcaatgcgcttgttttgatctatagatcttaggttcggagtctctgtgtgtgctttggtgtgggggttttctagtgacaaaaatagaatggggaaacaatcaaagtcaggagggtgtttggggtggttactggcgatagtaatattggctctggttgtgggagccattgtttatgcagtgaagcagaaaatcgatcacgccaatgataataagccatctcccgttccaggtcctncaggcgctattgacaagaagtatgccgatgc

SEQ ID NO: 25722 - DNA, 394 bp, Gossypium hirsutum
  Clone ID: LIB3272-053-P1-K1-H2
cttgcgacagataagtgaaaagatgccggactacttgaggggtggcgaagatgacgtttacgagctcgacgaatttgatccgacgccttacgggggcggatacaatgttgacctaacttacggtcgagctttggtaccctacgatgagacttgattcccttacggtacaccctacgatggcgactttggttatgcacgcaccgattattcttgcggttacccgcacttagctgatgccgacgaagctgttgaaactgaatgcagcttgtatgttaaacccaagccccgacctggacgactcggacctgcacctgcttttggagcttgatctggtgtctatggagggaaacccgaatatgagcaatttgaatttgtgtatggacgcaagccggat

SEQ ID NO: 25723 - DNA, 436 bp, Gossypium hirsutum
  Clone ID: LIB3272-053-P1-K1-H3
caaaagtttagggtttcaactatagagttaaaacttaaaagagtgatggaaggcttaatcccttatctcatccatgccatgaagaagcaaaagcctggccacaattacaggtcgacgtcggtgggatctagccgtagctaccatttgttggagggatcgtctcaccggcgaacaatgtctgagttccagccgcctgcgacggtggaggttgttgagcaaaggtcaggtttggggtacaacaacggttcttctagtgttggttcctatgctcatcagcaagcttcagtggggaacactggtgatgttagacgacgatgattgggttgtttaaatgtttggttgcatggatttgtttatttattttgttgtgatgagcagaaagcaagagtgctgtaaaatagggtaaagtttttcatctcaaataatggctttttgg

SEQ ID NO: 25724 - DNA, 377 bp, Gossypium hirsutum
  Clone ID: LIB3272-053-P1-K1-H4
cggtctcaaagctccaacctttcgcccaccaaatggggttctttcttttctttttcctttcgcttctctctttagcttcttcagcttccagagtggatcagaaaaccttcatcgttagagtccaaaacgaagccaagccttccgttttcaccactcacaagcactggtatgaatcttcactttcctctgttctctccccatcaactcctacccaacttcttcacgtctacgacagcgttttccacggtttctcggctaagctttcgccgactgaagccctcaagcttcaaacgcttccccatgtcatcgccgtcatacccgaacaagtccggcacttgcaaaccacgcgttctcctctcttcttaggtctcaaaacc

SEQ ID NO: 25725 - DNA, 290 bp, Gossypium hirsutum
  Clone ID: LIB3272-053-P1-K1-H5
cgaaattaaagctccaaccttatgcccaccaaacggggaactgtgtttgatggctggttgcgttattttattcaggccatgaagcttccaaagcgtgtccgcaaaaccttcatcgcttgatgtccaatacggacgcaagccttatgttccagtcccgaacccgcactggtatgaatattcactcgagctgctcccgtgagaaagaactgctacccaacttattgacgggtacgacagcgacttccacggtttctcggctaagctcttagcgactgaagcccttaaacttt

SEQ ID NO: 25726 - DNA, 447 bp, Gossypium hirsutum
  Clone ID: LIB3272-053-P1-K1-H6
agtgttcaacctgtgctctctggagttgcggtgggagctggatggcagcgcgtagtggcatgggttaacattgcctcgtattatctagttggcattccaattggtgttgtgcttggatacgtttggaatatgcatgtcaagggtgtttggattggcatgttgctaggaacattgcttcaaacaattgtactggttgtgatcacttggagaactgactgggataaacaggtcatcttagctcgcactcgacttaataaatggtttgtacctgaatccagagaagacaaccaaaatgtggctgcctgatttcaaatgcatttctttaaaattttggggtttctttggcctcaactttgcaatataccaaatgaagttacatcttgtatgtgactgcaataacctgttgtggatgaatatttgtaacaaaatttgatgcgttgtaatttc

SEQ ID NO: 25727 - DNA, 418 bp, Gossypium hirsutum
  Clone ID: LIB3272-053-P1-K1-H7
cggacgcgtgggttcccttagaagttgcgccgtttcagacacagccactcaaaggccccccgatcccacacccgatctctgattacgacgaagaggacgaggattcggcttcacaacaaaggtacgggtacaaaggtgcgcgggtgcgtggcagatgcagagggtacagaggctcacgtgaggggagcggctcgaaggtgcggttcgtgcgagggtagagcctgcggtgcctagatcttctggaaaccctaggagttttccgtttctgatttgggttttctggtgttgggccatttgggccgatttggttttaggtttttattttttctactggtttatttttggattacaggcccgggaaaatattgggccttacaggtataattccagttcctcaattgagttaccatcatgttcc

SEQ ID NO: 25728 - DNA, 424 bp, Gossypium hirsutum
  Clone ID: LIB3272-053-P1-K1-H8
ggatccttaagcagaggttgaaggtcccaccagcattgaaccagtttaccaagactcttgataagaaccttgctacgagtctattcaagctgcttctcaagtacagaccggaggacaaggcagccaagaaggaacgtctactgaaaaaggctcaggctgaggctgaaggcaaagcttctgagtctaagaaaccaattgttgtgaaatatggacttaaccatgttacctaccttattgaacagaacaaggcacaattggttgttatcgctcacgatgtggatcccatagagcttgtagtctggcttcctgctttgtgtagaaagatggaggtcccctactgcattgtcaaggggaaagcacgattgggatcgattgtctacaagaaaactgcatccgtcttgtgcttgaccacggttaaaaacga

SEQ ID NO: 25729 - DNA, 195 bp, Gossypium hirsutum
  Clone ID: LIB3272-054-P1-K1-A1
gtctgtagcaaccacatctgattggccttgggagttacagttacactggaccatcaaccaaagaaattaacgcctaccatgttcctaaaggggccacacttggcggtcctttactataataacccactcagattatgacaaaggctgccttacgattccattgtcctttgctaagtgagttcaagccccatattc

SEQ ID NO: 25730 - DNA, 408 bp, Gossypium hirsutum
  Clone ID: LIB3272-054-P1-K1-A10
aagaaaaaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaagagcccaccctcggcacctaaacagccagccacttgccccaaagatacactgaaactaggtgtttgtgctgatttgttgggctcggtgcgcgttgttgttggaccgtcgaggaccaaatgctgctcactcatttcgggtttggctgatctcgatgctgctgtttgcctttgcactgctattaaagctaatgtgttgggggttaacctaaacgttcctgtttcattgtctttgctcctcaattcctgcgaaaagcaaat

SEQ ID NO: 25731 - DNA, 331 bp, Gossypium hirsutum
  Clone ID: LIB3272-054-P1-K1-A11
caaaaacatagcagccatggcagtccgtatgcttcttgggttaggtgtcctgctactctgccttgcaaaggtttcatctgatctgaaggcagaagaagttataaccaatgtcggtgaggtgggttctttggttaccagaggcggaaacagaagactgatgctagagattgattgtggaggattatgcaagaaaagatgcagtcaacactcgaggccaaacagatgcaacagggcgtgtgggacttgctgcttgaggtgcaagtgcgtgccacccgggacttcagggacagggaggtctgcggacctgtatactgcatgacaccatggaacg

SEQ ID NO: 25732 - DNA, 374 bp, Gossypium hirsutum
  Clone ID: LIB3272-054-P1-K1-A12
aaaaaaaaatgtgcccgctgaggctgatcctcatattcctgtcggcaacactcgccggatttttcctccttagaaacatcaaatcccagccccaaaccaacgatgacgatcatacccgctccaacaacaataactcccactctgctttctccaaggtttgggcagctatagaatcaggattctgggcatctcttgacatggcaagtggtcgttacttgtggaggcatctggtttcctctaactccaagccttcctcttgattctgcaaaaaaaaccattctttgtaatggcagatgatgcagtgaaataaggcatgataagaactgcgggtttcaattatcttgtgccatacttatggttgtggatattggatg

SEQ ID NO: 25733 - DNA, 421 bp, Gossypium hirsutum
  Clone ID: LIB3272-054-P1-K1-A2
ctttgtttgagtgtatagatgaggaaaatcatgggtgccaaagttctcttcttctgtgctttgctttccttttcagctgtgttggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctcgccagacatgtgatgcttcactgctgctggactccacaagaaggagcttgtctgagaaggagacagacaggagccttggcctaaagaaatttaagtacattgagaccactcaagaagcttttgaaagggaatgttctgggggttgtttttgggctgaatatcctttttttggct

SEQ ID NO: 25734 - DNA, 409 bp, Gossypium hirsutum
  Clone ID: LIB3272-054-P1-K1-A5
ctcctttgtgccatcccttttaccttctccgagctcgttaaagagcagcctctggtgttgaagtaccacaatgggccaatcttgaaggggaagatcaccgttaatctcatctggtacgggaagttctccccaacccagcgctccataatcgtcgatttcatcaactctttgagctctgccgtcaaacccaagattccgtcggcgtcgttttggtggaaaacgacggagaaatacaagtccggttcctccactttggtcgtgggcaaacaaatcctcctcgaaaattacccgctcggtaaaacccttaagaacccacacttgccagcgttggccgggaaattcaacggcgtaggtacggttagcgttatcctcacggccaaagacgtcgccgtcgatgggttctgcatga

SEQ ID NO: 25735 - DNA, 384 bp, Gossypium hirsutum
  Clone ID: LIB3272-054-P1-K1-A6
atattcccaaacatgtctaaagcctgcttgcttttgtttctcgttggagtggtggtttttatcagcactccttctctagcgaagcaacatcatgataatgagcttcccaaggggaagccttttccaggtgagaagaaaccaccacacaagacgttttctgtacaccgaccgccaatacacacaggacctcgcggttaaagacaggagccaccacatggggaaaaacctcctcatagaaacttattgagtgtggaagttgagggcacacataaacctccacgacattcaagtggtaaaccttcaagacactcggggggtaaaccttcacatgttgaggggtttcctacccataaagcacccatgaagcccattcctggtgaaaaa

SEQ ID NO: 25736 - DNA, 307 bp, Gossypium hirsutum
  Clone ID: LIB3272-054-P1-K1-A8
tttgtttctcgtaaagtagtactactgtttctttattcaactgcttaattgtgtccctatgaagaatcctttgggttctcttctaagcttcttaggtttaaagaaaaagtcccctcgattagaactaccggagggcttttgctgtcgtttttcactagcgcagatcaaagccgccaccaacaacttccacccactctcaattattggtgaagttcgttttgggactgtttacaaagggactctacatgatggaaccatagttgctgtcaagcgcttgatgagatcgtcatatggaggaggaggagag

SEQ ID NO: 25737 - DNA, 276 bp, Gossypium hirsutum
  Clone ID: LIB3272-054-P1-K1-B1
tgattatctgccacctatcctcactacttaggggatctttactttgttcttaagcaataataacttgtctagtttggtgttactggctttggtagtaacaataaaacttgtttttgtgcttgtgtcatagtctgcagagctgcagtgttgtgttgctattgcttttccgtcatctgtgataccgtgttgtgattttagtgctgactggtataataaaacttgtagcctccgggtatatgttctgccgttattgttaattatttgttagttgttacc

SEQ ID NO: 25738 - DNA, 407 bp, Gossypium hirsutum
  Clone ID: LIB3272-054-P1-K1-B10
gagattatcaatttgaagccttcttcgaatttcctcattcaagatgcaaattttcgtcaagaccctcaccggaaagaccatcacattggaggtggagagttctgatactattgacaatgtaaaggccaagattcaggacaaggaaggcatccccccagaccagcaaaggttgatcttcgctggtaagcaacttgaggatggccgcacgttggctgattacaacatccagaaggagtccacactccacttagtgcttcgcctccgtggaggaatgcaaatttttgttaagactttgactgggaagaccattacattggaggtagagagttcagataccattgataatgttaaggcaaaaattcaggacaaggagggaattcccccagaccaacagaggctgatttttg

SEQ ID NO: 25739 - DNA, 267 bp, Gossypium hirsutum
  Clone ID: LIB3272-054-P1-K1-B11
agtttccctactcaggtcacctttgattcatcaatggcggtctctacaccatccccagtctcttaccttacaagaattgaacacaccaatctgtttccttccaaaaaactccaatttaaccccttttctcccgccaaaaagccattaacagtcgtctccatggctcccaaaaagaaggtaaacaaatacgactcagaatgggaaaaacaatggttcggagcagggattttttacgaaagaagtgaagaaattgaagtggatgtgttt

SEQ ID NO: 25740 - DNA, 408 bp, Gossypium hirsutum
  Clone ID: LIB3272-054-P1-K1-B2
ggcgaacgaagactttcagcacattttgcgtgtgctgaacaccaacgttgatggaaagcagaagatcatgtttgctttgacctccatcaagggtattggaaggcgtttcgctaacattgtttgcaagaaggctgatgtcgacatgaacaagagggctggtgaattgactgcacaggagctggacaatctcatgaccattgttgcaaaccccaggcagtttaagatccctgactggtttttgaataggcagaaggattacaaggatgggaagtgttcccaagttgtgtctaatgctctcgacatgaagttgtgagatgacttggagcgattgaagaagatcatgcaccaccgtgggctgaggcactattggggtctttgtgttcgtggtcagcacaccaaaaccactgg

SEQ ID NO: 25741 - DNA, 417 bp, Gossypium hirsutum
  Clone ID: LIB3272-054-P1-K1-B3
aaaaagagaaaataggaggagtaatatggttggggatgaagagtaccacttacatcatatattttatttacatcaaatttcccataaccttcatatctactcttgtttcctctctctctttcacttgcctttgcttcttttgtttgtgttttaaggaagacaaatcttcctcttttgcttttccactgattttcgtgatgaagtgcgccactatgacttccggatttgaaccctcgccgtccaaagacatgccagcggcggaggaggaagaagacgattggaggagttcgtcctcccccatgacctcctcttcgatcgggaggaacagtgatgctgacgtgtctggaagatcatcggacggcgacgatgaaaatgaggttcaaagctcttataatggtggtttaaacatgatggatt

SEQ ID NO: 25742 - DNA, 416 bp, Gossypium hirsutum
  Clone ID: LIB3272-054-P1-K1-B4
ctacgatgtccccaaaaaggattttcggtttcagttcatgaactcagttagagttgcggagaagccgttgaagcttacttacattcacggcagaggggacaaccggaccgtgttggacgggacactcaccttagactctgccaacaaggtgtcggctaattacatgtttggtacgaggaactgtaaggtcaagtacagttactcgcacggaggggctacgacttttgagccatgctatgatttcgggaagaatgcgtgggattttgcaatttcaaggagagtgtatgacgatgtttttaaggcaacgtatcagacgtggagcagggatttggctttggagtggtcgaggaactctaagtttaatgggacttttaagatttcagcatccgtcaatctggccgaagaaactaagatcc

SEQ ID NO: 25743 - DNA, 412 bp, Gossypium hirsutum
  Clone ID: LIB3272-054-P1-K1-B5
agccgctcctcactttccgaaccagacaggcgcagatcctctcagcccagcgaccatgacaaagagaacgaagaaggccggaattgttggcaaatatggtacccgttatggtgccagtttgaggaagcaaattaagaagatggaggtgagtcaacagcaagtacttctgcgagttttgtggaaagtatgcagtgaagagaaaggctgtaggaatctggggctgcaaggattgcgggaaagttaaagctggtggtgcttatactttgaacactgccagcgctgtgacggtgaggagtactattagaaggttgagggagcaaactgagagttgagctgctgctgactacgttatgttcacaactttggtatgatgttcgtgtatgtgttggctacaaaccagttgagtcatttt

SEQ ID NO: 25744 - DNA, 313 bp, Gossypium hirsutum
  Clone ID: LIB3272-054-P1-K1-B6
cggaacttggattattttgggcgaaggggggggaggatttgtaatatgacaatttgtactgcatcgaaaattgaatcgtttgcatcaacgaggaaggaggtgctcgcacatttcattgaatttttgaaagaagcttgattagcaaagggaggggcaaacattttttagaagatttgggcgcttaatgaaaagacttatagaatgggtgtatttgatgttaaaaagaatgagggatttaaccaacaggtggggcttgttttttttacactcacagcactggctttgaatatagcactttttgaattttttctgt

SEQ ID NO: 25745 - DNA, 400 bp, Gossypium hirsutum
  Clone ID: LIB3272-054-P1-K1-B7
ctacttttaacgttattttacttattccgtgaatcggaggcggggcacggaaaaagaaatacattccatggaattggacccctctgaaaactccaactggctccttgattatggcatacctgatttcccgccttcagctgccgccttcgcatggccttgtcaatctactctcaatgctccctctaatgtcagtgctacagttgattgctcctttgctgattcagattgcttgaaggatgttgtctctaggaaaagggtgaaatcggaatcatgcgggggatccggatcgaaagcatgccgggagaaattgcggagggatagattgaatgataggttcttggaactgggtgccgttttggagcctgaaaggccaatgaaagcagataaagttgctattttg

SEQ ID NO: 25746 - DNA, 402 bp, Gossypium hirsutum
  Clone ID: LIB3272-054-P1-K1-B8
gaaaaatggttttctcaatacattgaccacaaataccatacattagaagtcttacatacagttctttctttattttttttgccaccaaaccttcctactcctttccttaatttccctgtatataattccctttgtgtctaaacaacctccaaagctatcaccacttccaacatgggacttacagagtattatgtcaacatttttgtttctcttgtgctgcttgctttccttggattgatcctacgtttgtatcatgagttggtggtgaagccaatgaagctccgagcaagattactcaagcaaggcatcaaaggaccgtctccgagtctgctaatcggaaacataagagagataaagaaggcacaatccagcattgttaaggtttctagcatgcacccccct

SEQ ID NO: 25747 - DNA, 376 bp, Gossypium hirsutum
  Clone ID: LIB3272-054-P1-K1-B9
agccgctcctcactttccgaaccagacaggcgcagatcctctcagcccagcgaccatgacaaagagaacgaagaaggccggaattgttggcaaatatggtacccgttatggtgccagtttgaggaagcaaattaagaagatggaggtgagtcaacagcaagtacttctgcgagttttgtggaaagtatgcagggaagagaaaggctgtaggaatctggggctgcaaggattgcgggaaagttaaagctggtggtgcttatactttgaacactgccagcgctgtgacggtgaggagtactattagaaggttgagggagcaaactgagagttgagctgctgctgactacgttatgttcacaactttggtatgatgttc

SEQ ID NO: 25748 - DNA, 326 bp, Gossypium hirsutum
  Clone ID: LIB3272-054-P1-K1-C1
cggagcacgtcggcggggccctgggaagggagttatttttcttgtttaaacacgctcggcaccctgtgaacacgtctaacgggggtggggtccacagggcgtactcataaccgcataaggtgtctaaggggaacagactctgtgcaaagggacaaagtatgcaagggaggtcggcaaaatggatcctccacctcctgaaaaggagtgtctcttatggctggtcacggcggtgccaattcccaacccctcggttgtcggcgcactccttgagctggttcctccgggagagcgggtcgccccgtgccggccgggggacggactgggaa

SEQ ID NO: 25749 - DNA, 159 bp, Gossypium hirsutum
  Clone ID: LIB3272-054-P1-K1-C10
acgctagcattccttccacccgcttctttggtccacctctttttttctttttctccaaagccatcatgaatctcattaataggctcagccccaagcgtctctttcgatctaataaaaaagatagatccatcgtctccaagttcgacccctcctcctata

SEQ ID NO: 25750 - DNA, 412 bp, Gossypium hirsutum
  Clone ID: LIB3272-054-P1-K1-C11
acgcttaatttgtggggtttttttttttttttgggttgctgcttaatccatggcttcttccatgctgaatggagctgaaaccttcactctcatccgaggtgttaccccaaaaagtattggttttttggggtcaggtttacatgggaaacagttttccagtgcgggtttaatctacagtccgaagatgtccagggtaggaacgacgatagccccgaggtgcagcttatcagcgtcaaggccagcttcacaaccaagattcatacaacacaaaaaagaggccttttggttctacaggttcctctcaattgtctatgaccatgtcataaacccaggtcactggactgaagacatgagggatgatgcacttgagccggctgatctcaatgacagggacatggtagttgtagatgtt

SEQ ID NO: 25751 - DNA, 332 bp, Gossypium hirsutum
  Clone ID: LIB3272-054-P1-K1-C12
aagagcctctctcatggacccttattcgaccaatggttgaaaatctttaaatggtaacatcgtccttttgcccaccattatcaaattttcagatttttcaggaaaaagaaatcaaaaccacaaggtggagaaggtgaaaaccagcagcggcaaaggcaataaaaggtgaagccaaagagagagagatatatacataataaaaaagattcttcaaaagaacacagctatggctcctcatggagaaggatcagatgcttcagtggaagccatggttgctcaagtcgaaaaacacccaatttcatcaatccttatcatcattgctatgcaaacag

SEQ ID NO: 25752 - DNA, 416 bp, Gossypium hirsutum
  Clone ID: LIB3272-054-P1-K1-C2
ctcgtaaacagcaaggatcttataccatgaagctattctacacctcaaacatgcctatcatgctggagcttgcacttgatccaaatttttatttcatctcccagctgctgaacaggaagtacagtggtaacttctttgtgaatctgttgggttaatggaaggaatctgaatatgtcaggcggccaacataattgtgcctgtggatacccaacatgagggactgctctatcaagctaagctgtcatgggaaaaaatttcttccatgcatcaatttagcttgcgttcatgcttttagtatgaccgtgttttttaaaaactttgaatatggtgttttcaggtctaatatatacattgatttttttcaacaatccttatgtaggaaccttttttttttaatactactttctatttttttt

SEQ ID NO: 25753 - DNA, 263 bp, Gossypium hirsutum
  Clone ID: LIB3272-054-P1-K1-C3
cccacgcgtccgcggacgcgtgggtgaaattccaagcaaaatatcatgggcaagggtcctggtgggtacactgaaatcggaaagaaagctagagatcttctttacaaggattatcagactgaccaaaagttcactttgaccactagctttcccactggtgtttcaatttcctttgccggcacgaaaaaaggtgattttttttaggctgatgataaaacccagatcaaggaatggaatgccacaactgaaataaaatttgccaa

SEQ ID NO: 25754 - DNA, 336 bp, Gossypium hirsutum
  Clone ID: LIB3272-054-P1-K1-C5
cttggtaggattttctacggactgacttgcatgaatgatacgcgatgctctaccccgtgcactagtactttggttagtgataaggtgctccccctcacgctgctgttttgccgtctttcacgtcggagggggatgcagtttgagctgcgggatcttgtggcctaggcgccgactactaatgtgcacatgttgaggctatactgacgtgaaccctctttttccaccggagtactgagtttacaggctgttggctgtataatcgtgagttcaactggattatgtggttgttgtcaaagcatgatggggttattccagtgggcatttttttcagcatac

SEQ ID NO: 25755 - DNA, 410 bp, Gossypium hirsutum
  Clone ID: LIB3272-054-P1-K1-C7
ctgactccgtttgcattctctctcagctttccggtcgaagaatcattcaatttaaggggaaaaagaaaaaaaaataccaaacatgtcgaaatcggtgattgaaatgcctccaaagggtgggtttagcttcgatctttgtaaaagaaacgagatgctttcaaagaaaggcgttaatccgccgtcatttcgtaaaacgggtaccacaattgtcggcttgatcttccaggatggtgtaattcttggagcagacactagagcaactgaaggacttatagtttgcgataaaaattgtgaaaaaattcattacatggccccgaacatttactgttgtggagctggaactgctgctgacacaaaagctgtaactgacatggtcagttcacagctccagttacaccgctatcatactg

SEQ ID NO: 25756 - DNA, 402 bp, Gossypium hirsutum
  Clone ID: LIB3272-054-P1-K1-C8
ctacctctctttccctctctctaatgacgcttagctcaggaggatctagtgtcgtggtgcctcggaacttccgattgctggaggagcttgagcgtggagaaaaaggtatcggagatggtactgtcagctatggaatggatgacggagatgatatttacatgcgctcatggaccggcaccattattggtcctctcaataccatacatgaaggtcgaatctatcagctgaagctgttctgtgataaagattatccggagaagccaccgagcgtccgttttcattcaaggatcaacatgacttgtgttaaccatgaaacggggctggtagaatcaaagaagttcggaattctcgcaaattggcggagggagtatactatggaagatatactgacccagctgaaaa

SEQ ID NO: 25757 - DNA, 348 bp, Gossypium hirsutum
  unsure (1)..(348): unsure at all n locations
  Clone ID: LIB3272-054-P1-K1-C9
agaaataagaatacataccctagggtaaataggacattcgtcttgatggtctgtttcacgactggtacccatntctgaactaaatgctatgggttttatatccaaagctgaaccttgtaaaagaggggacttaaaagaacacaagatttgacaaaaggtgaacgtttcactcttttttttttaattgcataattagagtaaagtaaaaagtggaaactgcatggtgaaatgcattggtgaaagcacccatatctttgcgaaagtgcttgagagaaactacacggtgttggtggtgagaatggctaattctgtggaattgacaaagaacgacaagaatttcatcaaaac

SEQ ID NO: 25758 - DNA, 333 bp, Gossypium hirsutum
  Clone ID: LIB3272-054-P1-K1-D1
cccacgcgtccgcggacgcgtgggtgaaattccaagcaaaatatcatgggcaagggtcctggtctctacactgaaatcggaaagaaagctagagatcttctttacaaggattatcagactgaccaaaagttcactttgaccactagctctcccactggtgtttcaattacctctgccggaacgaagaaaggtgatcttttcttggctgatgttaatacccagctgaagtctaggaatgttacaactgatatcaaagtggacaccagctccaatctatttaccaccataacagttggtgaacctgcacccgggcttaaggcaatctttggcttt

SEQ ID NO: 25759 - DNA, 366 bp, Gossypium hirsutum
  Clone ID: LIB3272-054-P1-K1-D10
cttgccacgcagctaaactcttctgagtcaaaacatggcaactatcttcgagtttcaagaagaagaggccagaccttccgcttcttcatcgccgaaagcggtgccgtttaacgccagcttggatccgacggaccctgttgggtttctggagaaagttttggattttctggccaaagaaactgattttcttgagaaagagaacttcgataaggagattgcagtggtcgtgagagttgctaaggagaaacgtaagcagaaggttgaagaggtggctcccaaggtggagataaagaaggaggaagtgaagaaagagaaggagatcaaggaagaagtgaatagggaggcaatggaggtcgataaaaacga

SEQ ID NO: 25760 - DNA, 171 bp, Gossypium hirsutum
  Clone ID: LIB3272-054-P1-K1-D11
gaaacttcaactatttggggggatctgaattgtaatttgttgaaggttccttaatgctttagacctcgatctctatttaaactcctagcacccctctgccataaacaaaaaaacaatattatttttatggtttaatggagatgtggacaatccaaagaagaaacccgggtc

SEQ ID NO: 25761 - DNA, 281 bp, Gossypium hirsutum
  Clone ID: LIB3272-054-P1-K1-D12
cttcaacagacccccccccaaaaaaaaacccttgaactttttccgcagtcaaaatgggtatctctcgtggttcgatgcacaagaggcgtgccactggaggtaaaaagaaggcttggaggaagaagagaaagtgttagcttggaaggcgaccagcaaacacaaagctcttaagccacaagacagtttggaggattagggttcgcgggggaaatgtcaagtggcgtgctctgaggctcgacactggaaactactcgtggggaagtgaggccccgactcttaag

SEQ ID NO: 25762 - DNA, 418 bp, Gossypium hirsutum
  Clone ID: LIB3272-054-P1-K1-D2
ggatttgcagaaagatccacccacttcttgcagtgctggtccagtagctgaagacatgtttcattggcaagcaacaatcatgggaccctcagatagcccttatgctggaggtgtgtttttagttactatccatttccctccagattatcctttcaagcctcctaaggttgcatttaggaccaaggtcttccatcccaacatcaacagcaatggaagcatttgtcttgatatcctcaaagaacaatggagccctgcactaaccatttccaaggttctgctctcaatctgctcactgctgaccgatccaaaccctgatgaccctcttgttccggagattgctcacatgtataagaccgatcgggccaagtatgaagccactgctcgtagctggacccagaagtatgcgatgggatgacag

SEQ ID NO: 25763 - DNA, 411 bp, Gossypium hirsutum
  Clone ID: LIB3272-054-P1-K1-D3
cacgcttacgccttacgccatacgcatttgcccgcacgttgttttgtgctctgtgtttctcaataaattccttattcctacaaaacccccaaaattaaagaaggatcaaaccgaccctttgcaattccaagacacaagaaccaagagacataccacgatggcaacaacgacggagaagcaagccatggttgttggaatcgacgacagcgagcacagtacgtacgcgctgcagtggatcctcgatcacttctttgctcctttcgcttccaatcctcctttcaagctcgtcatcgttcatgccaagcctactgcttcttctgctgttggtctcgccggacctggagctgctgatgtattgccctatgtggatgcggatttgaggaagatcgctgccagggttgttgagaaagc

SEQ ID NO: 25764 - DNA, 399 bp, Gossypium hirsutum
  Clone ID: LIB3272-054-P1-K1-D4
gatcgattttgctcccattaatcccttccttaactccttttcatgctggtttaagttcccatcgtttgaagcatcttgaaaagagtgatcggcgtggtaatcttagttaacgttttcccctcaaaatcattagctctcttttgactcctttactttctctccttttttcctctctgttttctgtcttcccctagagtcgtccgtttcttttgaggctattaccgtgcgacacgaaagaatctagtttgctcagaaagaaaaaaaaaacctggagatttggttcgatcttgagctggagttgcttttttcagaggttttaagatcttgtattgatttcacttaccgcagctttcttaagaaaggtatatcattccttatccgtttagcacgtgctacccg

SEQ ID NO: 25765 - DNA, 461 bp, Gossypium hirsutum
  Clone ID: LIB3272-054-P1-K1-D5
agcgctgagccggtccggaatctgcccgcactgcgacccacgtcgtaccgatataccacgcagctaaactctttatggatacaacatggttacagcaatcccaccagctaaaatgaggcacggcttgtatccttgatggtgacactctcattccccagattcttcctcaggcttttaagagtgttgagtacattgaaggcaatggtgaggccggtagcatcaagaaggtcacttttggagaaggaagccaattcaaatacgtgaagcagaaggttgaagcagtagacaaagacaaatttgtgtatatttacagtgtgatcgaaggtgatgcattgatggataagcttgagaagatctcttacgagacgaagttagagacctctccggatgggggatcagtatgcaagactactagtaagtattacaccattggtgagtttgagctcaaggaagagggaatc

SEQ ID NO: 25766 - DNA, 113 bp, Gossypium hirsutum
  Clone ID: LIB3272-054-P1-K1-D6
cgccgcggtaccgttccgggattacccgcgcggcccaccccgtcggaaacttcaactatttggggggatcgcgaagggtaactggtggaaggtccttaaaggcttagacccaa

SEQ ID NO: 25767 - DNA, 423 bp, Gossypium hirsutum
  unsure (1)..(423): unsure at all n locations
  Clone ID: LIB3272-054-P1-K1-D7
cacgcccgtccgctactgcatcatctaantttgttgtgcgtttcttctttttgggcatcaatcactcgcgtttctgtgttctcgcatctattatantttttcctccgatttatacacatgtccgaaatcttttctcttttgtgatttgcaaagnaaaagaaacatgaagggaaagttgggcaactcctcttcacctcaaatctttgaaccacatcttccttgtgtgtagatcaggtgaggaatccatgaacttttattaagatattcttgggtttggtccaatcaggagacctggatcatttggctttaaaggggcatgggtggttggataccggaatggaatacattttctggaatcgggggatccagagaggttggcttagaaaaaaggaaatcaaccccagggttatcacattttttttc

SEQ ID NO: 25768 - DNA, 407 bp, Gossypium hirsutum
  Clone ID: LIB3272-054-P1-K1-D8
aagaaaaaaaagttagggttttaatttgaaatcggattcggtagagattaagcaatggctggagaaagggccttgttcaagttccttaagcctgggcaacgtctacagcccgccgacgttcaagctgccgccatgtggggcgtcgctgccactaccggcgctctttggctcattcagccttttgattggttgaagaagacctttctggagaaaccagagtcggattagaagcaaatgggacatcttgcaactcattgcggttttgtttatcgggtttgctgatgaacaaatcatggaaagaataaaaataataatgtagtaagtgtaattttttgtggtttattgttaagagaacaagcctctttgcttttggtatcaattactgggaagttttgaacctttcacct

SEQ ID NO: 25769 - DNA, 414 bp, Gossypium hirsutum
  Clone ID: LIB3272-054-P1-K1-E1
gtctcaacattttttgatcaagttgtgacgctttccactcatccttatgggtgccgagttatacagagaatattggagcactgcaaggacccaaagacacagagtaaggttatggatgagattttaggatctgttagcctgttggcccaagaccagtatggcaattacgttgtccagcatgtgctggggcatggaaaacctcatgaacgctcaatcatcattaaggagctggctgggaagattgtccagatgagtcagcagaagtttgcatctaatgttgtcgagaagtgcttaacttttggtggccctgctgaacgtcagttattggtgaatgaaatgcttggttctactgatgagaatgagcctcttcaggcaatgatgaaggatcagtttgcaaactacgttgtacagaaa

SEQ ID NO: 25770 - DNA, 404 bp, Gossypium hirsutum
  Clone ID: LIB3272-054-P1-K1-E10
ctttgtagtatgtttctctcacacgtcccatctccttcctttttctctctttctttgttaatggaaatcaactaatcggcgatcatctcttcctctttgtgaactgatcgctgggtaattctataatgccaaccttcattttaagcttcctttgcttttcaatgatctcgtctgaatattgaccgatgattttgtttttgaaggtcacagcgagaagttgatatcattttttatatttatataaaatttcttaaaaggggttcggtgtcaaagctgagtcataatacgaaatgctagatcttaatctcaatgtcgcgtcgcctgagtcgactcatggattggactcggcggcaccttttactgatgagctcaacaaccaaggttcaaggaaccaaatggaccaa

SEQ ID NO: 25771 - DNA, 229 bp, Gossypium hirsutum
  unsure (1)..(229): unsure at all n locations
  Clone ID: LIB3272-054-P1-K1-E11
gtccggaaaaaaanggggcgagccaccccttcccttgccttcttttgttctaatggggagaaaccaaagaagtgttaacgcccccccaggggaagggtccttttcctaggaagtgttctatcatatatttagttgttttttggaaccatataaaaagatctaaaataattctttttaatttcattaaaggaccttctggggaggttattaatttctccctcccccctta

SEQ ID NO: 25772 - DNA, 413 bp, Gossypium hirsutum
  Clone ID: LIB3272-054-P1-K1-E2
ggaaaatctccattttagcagactatcttcgccgcctcctcttcctcctatctcatagcagccatgatcattccagagaagaaccgccgcgagatctccaagtacctctttcaagagggtgtttgctatgcaaagaaagattacaacttggcgaagcacccagaaatcgatgttcccaatcttcaagtcataaagctgatgcaaagcttcaagtcaaaagaatacgtgcgtgaaacttttgcatggatgcattattactggtaccttaccaatgatggcattgagttccttaggacatatctgaatcttccttctgagattgttcccgctactttgaagaaacaagctaagcctgctggtcgtcccatgggccctcctggtgaccgcccacgtggtcctcctcgctttggtga

SEQ ID NO: 25773 - DNA, 416 bp, Gossypium hirsutum
  Clone ID: LIB3272-054-P1-K1-E3
aagagtcgccctttggtgtttttctaattcaatcagtgaggtgaagaaaaatgtcttgctgtggtggaaactgcggttgcggctccggttgcaagtgcggcggcggcggcggctgcggctgcggcggttgcaagatgtaccctgagatgaactttgctgagcaaaccacaactgagacacttgttcttggcgtggcaccccggaaagtgaactttgatggagctgaaatggaaactggggctgaaaatggctgcaaatgtggagataactgcacttgcaacccttgcaattgtaaatgaggggaaaaaaaaaaaccgaagcatattatggaagctgatctaaataatatatgatgtatttgggtttttattattagaataaagcagccatggttcattaggtgttttgcttcttgg

SEQ ID NO: 25774 - DNA, 338 bp, Gossypium hirsutum
  Clone ID: LIB3272-054-P1-K1-E4
ggcagagagctgcccttttattcccatgttctatgctctcttcagtctctcccttttgacctttatcttcttcataattgttgctggtataaactggggaacagttatgactttgcttctctttttaccactgtctgtgtttatccaaataaaagattcatttcatggccaggtgaagagcatccatcagttctagttagtcggaccggaccttttgtacgttccatttcatggtcaaatgaggagtgcccatcagtttgtcaacttgcctgattctgctcctttcttttgatcctatcataggtatgtcttgcttgaagtttatcaggtttcttttt

SEQ ID NO: 25775 - DNA, 334 bp, Gossypium hirsutum
  Clone ID: LIB3272-054-P1-K1-E5
ctgccctcctctgctcctatggcgatgaaacaaaggagcttcaacgacgccacaccggtaagttccctttactcccttcctcgttttgtttatttgttgttttttagaagcaaaagaaaagaactaaaataaattgaaaaaaaaacagtaaaggaacagagaaaaataaaaccaaatcccaccttcaaaaatatttttctgtatattttctttttgatttcggtacaaaaaaaattttgctccccattacaaagatcgattggcctttatatggtcgaatcaaaaaaacaagcccttgaaaactttcccccatttacatttttgtcatattttc

SEQ ID NO: 25776 - DNA, 202 bp, Gossypium hirsutum
  Clone ID: LIB3272-054-P1-K1-E6
cacactacgactcatccgaatgggattattcacagagaagagcaagcgcaaacgaagtgtctctctttcttttgcgcttcggacaaaacccatctaagcgctttagttgacaacatatagtagttcaacggctggttctacttgtttgacaccttgaagcttggagggtttcttgcgaaaagtacttgtcagttttaatcta

SEQ ID NO: 25777 - DNA, 409 bp, Gossypium hirsutum
  Clone ID: LIB3272-054-P1-K1-E7
tgttgagaagcaaggtatgagtgatactaggttcttggagaatgggaagtactaccatgatgtgagttctgagaacaactactacccgaaccggttcgagaactcgaggggagtcggttcgaggaacgagttcaacgagaaccgttacaataacatgggaaaatataatcagaatcaagaggagttcgaagaagagttcgagccatgaaaccacacgtatatgctaattaattagcaaaaagagagtaaggaagaaagggcttatttattgggttttgcgttttattttgggatcctttttattttatttgcagggtttgatagtatcctttgcttttgatattgaaatgctaaaagatattataatggagccttaagctttttacttttcttaaacagggttatgcaa

SEQ ID NO: 25778 - DNA, 266 bp, Gossypium hirsutum
  Clone ID: LIB3272-054-P1-K1-E8
aaaaaaccgttgaatctcgggaagaggccgaccccgacaccgacgccgactcgggtcacgcgctaagtcagcgacagcatctgccatgaaactcgagcctatgagctcagacacatgcagagaatggtgtcccgcgcagggatctaatgagagaggtggctggacatgttccgtggacaagcaaagggataagggcagggggagttggacttcactgatactatggcatgctcattagaacgatgccgacgatgagcgaaaacttc

SEQ ID NO: 25779 - DNA, 406 bp, Gossypium hirsutum
  Clone ID: LIB3272-054-P1-K1-E9
cgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaagagcaaccccctttcgacaagaagcagtttgtcgtgttcatcaagaagttcatcaagaacttgacaccaaaactggatgcggaaaagcaagagtccttcaagaaaa

SEQ ID NO: 25780 - DNA, 351 bp, Gossypium hirsutum
  Clone ID: LIB3272-054-P1-K1-F1
cccacgcgtccgattcccaaacatgtctaaagcctgcttgcttttgtttctcgttggagtggtggtttttatcatcactccttctctagctaaccaacatcatgataatgagcttcccaaggggaagcctttcccaggtgagaagcaaccacaacacaagccattctctgtacaccgaccgccaatacacagtggacctggcggtaaaggacaggagccaccacatggggaaaaaccttctcatagaaacttattgagtgtggaagttgtgggcacacataaaccttcaccacatttatgtggttaacctccaagacactttgggggtaaacctccacaagttgagggggt

SEQ ID NO: 25781 - DNA, 422 bp, Gossypium hirsutum
  Clone ID: LIB3272-054-P1-K1-F11
agagttgcctgtagaccatgtggagaagaaaccttctcagatgattcttgataagaagtttgcagggacgctggatcagggtgctggatgccttgtcatctttgacgatcccaagagtgatgccattttccctgcaacattggaaaccctctataacattggcaaggttgtagataggccttatggggggggtggtaacataatgggctaagagtcaagatttaccgatgcttatatacagcttgcaactcggttctagcgaaaaacaagtgttcaggtacactgtatatgcacatgttttgacgtttcagcttttaatttaatgggattgcggcacaacatttgggtcaaaatatggagttgattcagacaatattgtgtttgctcaccatatgcttgtctactggttgacttttcaatta

SEQ ID NO: 25782 - DNA, 103 bp, Gossypium hirsutum
  Clone ID: LIB3272-054-P1-K1-F12
ttggaagcatggactaaatagctactatcctgtttctagctgtgggcatctactccaccaaagctttggacccttgcggccctcagccgatgactcgaccttt

SEQ ID NO: 25783 - DNA, 417 bp, Gossypium hirsutum
  Clone ID: LIB3272-054-P1-K1-F4
aaaaatttatttttctcaaattatttttttcctttttttttgagtgacgaattcaagcatgagtgagctcactcgttatagtcgggtattactgttaatggtattaggattaagcgcgggagcctgttacggtttcggtactttcggattcgaattccatcacagatactcggatcccgttaaacaaatcctggccgtcgatgaattgccgccgaaaggaagtccggaatattacagtgctatgatccaccgcgataaaataatcaagggccgttcattggcggtagagaacgatcagacgccggttacttttctcgaaggaaacgcaacttatcgattgaggtccttgggatatttgcattacgccaatgtgaccgtggggacaccagctttttggtttttggtagcattagacac

SEQ ID NO: 25784 - DNA, 416 bp, Gossypium hirsutum
  Clone ID: LIB3272-054-P1-K1-F5
aagaaataaaggaagaagaagcaatggtcactcttacagtgcctacgacagttacttcagtgtctgaagattgtgaacaactaagaaaatcctttttaggatggcgaactaatgagggcttaatcatagatatattgggtcacagaaatgcggagcaacgaaacttgattcgaaaaacctacgctgtaacctatggagaggatctcctcaaggcactagacaaggaactctcgaatgactgtgagaggctggctatgcttaggactcttgatcctgctgaacgagatgccctttgggctaatgcagccaccaaaaggtggactttaagcgatcaagtccttatggacatagtctgcacaaggtctgtcaaccaactgcttcacgcaaggcaggcttatcatgctcaatataagaag

SEQ ID NO: 25785 - DNA, 159 bp, Gossypium hirsutum
  Clone ID: LIB3272-054-P1-K1-F6
tgagttgcctgtagaccatgtggagaagaaaccttctcagatgattcttgataagaagtttgcagggacgctggatcagggtgctggatgccttgtcatctctgacgatcccaagacggacgccattttccctgcgacattggagactacctataacat

SEQ ID NO: 25786 - DNA, 406 bp, Gossypium hirsutum
  Clone ID: LIB3272-054-P1-K1-F7
cccttactaacaacaaaaaccctgaaatgtcggacgacgatcatcatttcgaatccaaggctgatgccggcgcctccaaaacctatcctcagcaagccggtactatccgtaagaacggctatatcgtcattaaaggccgtccctgcaaggttgtggaagtttccacctccaagacggggaagcacggtcatgctaagtgtcacttcgttgggatcgatatcttcactggcaagaagttggaagatattgttccctcctcccataactgtgatgttccgcatgtcaatcgtactgactaccaattgattgacatttctgaggatggatttgtgagcttgctgactgatagtggtgatactaaggacgatctcaggctcccaactgatgagaacttgttgaaacagat

SEQ ID NO: 25787 - DNA, 390 bp, Gossypium hirsutum
  Clone ID: LIB3272-054-P1-K1-F8
gtctctctctctctctctctctctctcaaagggtatcatttttcaagctctcaattttctctggattcaaatcctctattttaggttgggtttttctggtgttatcaatgttactgcccttgttcctgtttggctgtagtttgaatttggttgattgatgaaacttagtggatactgttttgtttggaattgaatcatgaagatttttatgaggtttaccagtgggtttgtagattgattggtgtatgaatatacgatttggctgaaatttttcatttgatttgcgaagagggcaatagaagagcttttgttgtttggtacgggtttttcaacttatctattaaaggtgaaaaaaaaagagagggtcttctttttagagcaagattaaaa

SEQ ID NO: 25788 - DNA, 365 bp, Gossypium hirsutum
  Clone ID: LIB3272-054-P1-K1-F9
tgaagctcttacagaggcacttcctggtgataatgttgggttcaatgttaagaatgttgctgttaaggatctcaagcgtggttatgttgcatccaactccaaggatgatcctgctaaggaggctgcaaacttcacttctcaggtcatcatcatgaaccatcctggacaaattggaaacggatatgccccagtcctcgactgccacacctcacacattgctgttaagtttgctgaacttttgaccaagattgacaggcgatctggtaaggagcttgagaaggaacccaagttcttgaagaatggtgatgctggtatgattaagatgattcccaccaagcccatggttgtggagaccttttctgagt

SEQ ID NO: 25789 - DNA, 414 bp, Gossypium hirsutum
  Clone ID: LIB3272-054-P1-K1-G1
ctttgctataccctaggactatagggttctctttcgatccatgcattactttcaaattttcttcttagatcaaacaaaacaatgtccggcgtttgggttttgaagaatggtgtggctcgcttggttgagaatccagcgggtgagtcattagacggaagccgaccgagttcgaacactcgccgcaaagtgcttgtgcacacttcttataatgaagtgatcacttcttatgcggatctcgcacataagctatggtctttcgggtgggaacggtcttacaaggaccccagggttgttgaattccataagcgatcaactgtgcatttgatctctctcccaaaagatgttaatacgttcaagtcggttcacatgtatgacattgtcgatgaaaaccataacgtgtgtgaagttagggat

SEQ ID NO: 25790 - DNA, 409 bp, Gossypium hirsutum
  Clone ID: LIB3272-054-P1-K1-G10
tctagttttgatacgtccttttttttgttcatttctggatgacttggtagctttgttttacaggtaaattttatagttttgttcgtggaaagaacagagattcagagatgagtaagcttcagagtgatgcccttagagaagctatttcaaccattgtagctcagtccaaggagaagcagcgtaagtttactgagactattgaactccagattgggttgaaaaactatgatccccaaaaagacaagcgtttcagtggttctgtgaagttgccacacattcctcgccctaaaatgaagatctgcatgcttggagatgcccagcatgttgaagaggcagagaagataggtttggattatatggatgtttgagcactgaagaagcttaaccagacaaaaagttggtaaaaagc

SEQ ID NO: 25791 - DNA, 228 bp, Gossypium hirsutum
  Clone ID: LIB3272-054-P1-K1-G11
agccgctcctcactttccgaaccagacaggcgcagatcctgtcaacccatcgaccatgacaaagagaacgaagaaggccggaattgagggcgaatatgttacacaccttagtgccagattgaggatgtatattaagaacatggaggcgtgtcaacagtctgcacttctgggagagctggggaaagtattcattataaaaaacgaatgtattatgagatgatgtgggga

SEQ ID NO: 25792 - DNA, 292 bp, Gossypium hirsutum
  unsure (1)..(292): unsure at all n locations
  Clone ID: LIB3272-054-P1-K1-G12
aaataaattcaaatttcattctgttattttattttattttattacatattttgcgagatttagaacgattagcgaaaatgaatatcttcagattagcaggggacatgacccattggttaggggtcttggtttggttctttagatccacacaaccaagtcttgtgctggggtttttctgtagactaaagaacactatattgttgcttttttactcggtgcttggncatatttactaattatattttaccttattacaaaatcatgaagctaatattcctgggcaggttttttt

SEQ ID NO: 25793 - DNA, 420 bp, Gossypium hirsutum
  Clone ID: LIB3272-054-P1-K1-G3
gaaagacaatatgtttgtcactgggagggttgtggaaagaaatttttggatagttcaaaacttaaaagacacttcctcattcacactggagagagagacttcatatgcccacatgaaggttgtggtaaggcattctccttggatttcaacctgaggtcacacatgaaaacacattcacaagaaaactaccatatctgtccatacccagattgtggaaagagatatgctcatgagtacaagctaaagaatcacattgcatcacaccatgaaaagaacacgacaccagaagtggcaaaatatgccccacctttagagaagatagttaaaactccaaagcctactggtggcacctatggttctgcatcatctgatcgcccttatgcttgcccttatgaaggttgtgagaaagcttacatacat

SEQ ID NO: 25794 - DNA, 262 bp, Gossypium hirsutum
  Clone ID: LIB3272-054-P1-K1-G4
agaattaaacttttctgcgctcttttgtctttgccggttcctcctaatgtggtgaaccctgctggggaagatgtcagccagaggaccctggagcaacaagtgcttcttaaacttctactagttggctatcaaaaatcaggcacaagtaccatatataagcaagccaagattcttggtaaaggtcctttcttaaaaaatgaacgcccaaatatcaaattggagatcccatgcaaattgggtggatatcttgctatattgcttg

SEQ ID NO: 25795 - DNA, 217 bp, Gossypium hirsutum
  Clone ID: LIB3272-054-P1-K1-G5
agccgctcctcactttccgaaccagacaggcgcatatcctgtacatcccagcgaccatgacaaagggaacgaagatggcctggattgttgacaagaatagtacccgttatattaccaagttgaggagtcatattaagaagatggatgtttgacaacatgaagttcttttgaaagtgaagtggaaagtgtgcactgaaaagaaaggctttcagaatgt

SEQ ID NO: 25796 - DNA, 202 bp, Gossypium hirsutum
  Clone ID: LIB3272-054-P1-K1-G6
gcattttctgcaccgccaaacagcaattttagttcatttctagacgcagggaacgatggcgaaagcgatcaaccgacagcaagttttgtcttaacaccttaatccttcagcttgtgctttttcgtcagaccaaagcaactttgccctctttgaactgcttggttagctggagatagcgctgcttatcaaaaaactaatgtat

SEQ ID NO: 25797 - DNA, 168 bp, Gossypium hirsutum
  Clone ID: LIB3272-054-P1-K1-G7
gtgccgactgtcatactcatttacccccgctcattaacaccagactgactacagtcatttgttatcactgacagatgtcttgctctgggggaaacgagtggctgctggcctggatgacagtgacgccttagctatggaggatgcgccatgtacacacacctgaacctt

SEQ ID NO: 25798 - DNA, 408 bp, Gossypium hirsutum
  Clone ID: LIB3272-054-P1-K1-G8
tgcgagggtggctaatgctcattcattcattgtgaagctacctgatggtttcgacactcaggttggggagagaggacttcaactctcaggtggacagaagcaaagaatcgctatagcgagggcaatgttgaagaatccagcaatcctgttattggatgaagctactagtgcactagattctgagtccgaaaagctggtgcaagaggcccttgatcggtttatgattgggaggactactctcgtaattgctcatcggctttccactattcggaaggctgatcttgtagctgtactccaggagggaagtgtttcggaaatcggtacgcatgatgaacttatggccaaaggagaaaacggtgcttatgctaaactcattcggatgcaagaggcagcacacgaaactgccct

SEQ ID NO: 25799 - DNA, 318 bp, Gossypium hirsutum
  Clone ID: LIB3272-054-P1-K1-G9
ccttgagattatcaatttgaagccttcttcgaatttcctcattcaagatgcaaattttcgtcaagaccctcaccggaaagaccatcacattggaggtggagagttctgatactattgacaatgtaaaggccaagattcaggacaaggaaggcatccccccagaccagcaaaggttgatcttcgctggtaagcaacttgaggatggccgcacgttggctgattacaacatccagaaggagtccacacttcacttagtgcttcgccttcgtggaggaatgcaaattttttgtaagactttggctgggaagaccatttcat

SEQ ID NO: 25800 - DNA, 416 bp, Gossypium hirsutum
  Clone ID: LIB3272-054-P1-K1-H1
ctcactccgccatcttcaataatttcttccgttgatctttgttagagattagctttttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacctacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggctgctgctcacttgaaggg

SEQ ID NO: 25801 - DNA, 288 bp, Gossypium hirsutum
  Clone ID: LIB3272-054-P1-K1-H10
cacgacatacaattgatatagtgtcacctaaggggaagtgaagggtgcgcaacaactcgcactctttcttacagtcgcactctaattctaatattagagggtataaattaggataaggtctaaggtgggtgagtgagtgagaccagatccaaacctatcgtcatttcgaacggatgctacttctttattgcctcagggcgctgctcttatactattttcttggttggatggatgggttgatttatacacagtggccggttcaaaagtcagaaacctaactgcaactgc

SEQ ID NO: 25802 - DNA, 270 bp, Gossypium hirsutum
  Clone ID: LIB3272-054-P1-K1-H11
gaaaaaatattggtgccaaaggtctcttcttctttgctttgcttttcttttcacggtgttgcatttggcgaggatgaaaaacacccttatttttttgaacttctacaaagattcttgttcttaggctgaaaacattatcaaggagcaagttaagctactgtacaagcgacacaaaaacacttctttttcttggctgagaaacaattttcatgactgtgctggccacgcatgtgatacttcactgttgctcgactccacaagaaggagctc

SEQ ID NO: 25803 - DNA, 414 bp, Gossypium hirsutum
  unsure (1)..(414): unsure at all n locations
  Clone ID: LIB3272-054-P1-K1-H12
cttgtaacactgctaatatttttttttatcgtcgtctccgtcgttcgaaagatataaaaaaccggcgtcgtttcaaatggctacaagaacggatcttgatgggaggccataaaggcgttgacgatatgcatgatccgcgcccgagggtttatttggttcacctttttgagaaattgatgtctgagacgccgcacaaggtgctcgccttggacgtttacaatgacaagatcaagcatnttctcgagcctgactctctcccttgggctggccgtattcagttccaccgacttaacattaagcacgattctaggctcgaaggcctcatcaagatggcagatctcacgataaatcttgctgccatatgtactccggcagattataatacgcgtncactagacacgatttacagcaatt

SEQ ID NO: 25804 - DNA, 416 bp, Gossypium hirsutum
  Clone ID: LIB3272-054-P1-K1-H2
ctagaacataaattcccactctcttttatgcaaattagggtttaaaattttgctgatattttcgagttgcaatggatgtagaagatgacacaagagagggcttggcttcctccattatccttcaatctttggaatccactcggcagggagataagctttctgatgaggatttggcttgggttaattcttgtctggttacagatactgaaattttggaaagaaattggtcttctttcaaagatgttttgctggagatcattggtgaccaacctgagccacttgactcttctgcaactggaagcaatggttttttttagtgaactgaaatcagatagctccttccatcaaggaggcagaggctgccaattacttcaggagaactgatgaagatcttcttgtcatttcagtggatggag

SEQ ID NO: 25805 - DNA, 360 bp, Gossypium hirsutum
  Clone ID: LIB3272-054-P1-K1-H4
cggacgcgtgggttcggccaagccccaaaaggagcacgggatgtgcaagacagagcagttttttggggggggggggttgtttgggcaacaactcgtactctatgttacagatgatcccgtcgaactgcatatatacggagatcccaagggaattccaattcagcaaaccatgtatcgggatacccctgctccttttaactgcccattttggggtaataccggactcactctggtcagatctaaacctagcctagcagcggttgttggatgcatgatgccatttatgcttggaatctgctttctttgcccttcaatggactgcctttggcataagtattattattgtcccaaaagcactga

SEQ ID NO: 25806 - DNA, 364 bp, Gossypium hirsutum
  Clone ID: LIB3272-054-P1-K1-H7
aaaaaggggttccaagagaaaagtagaagaaatggcctcaaagcttcttcgtcaaaccctaaccaaaaccaacagaaccgccgctatacgctgcttcttcaccgcggcttctgtcgcttccccttccgagtatgagtacccaacaggaatcaccatgaaaggtgtgaaaatttcgggtcgtccgctttacctcgacatgcaagcgactacccccgtggatcctagggttttagattcgatgcttcctttttacctctctcgttacgggaaccctcactcccgtactcacctgtatggttgggaatctgaaaccgccgtcgaaacagcccgcgcacaagtcgcggcactcattggggctttcccg

SEQ ID NO: 25807 - DNA, 323 bp, Gossypium hirsutum
  Clone ID: LIB3272-054-P1-K1-H8
gtgaacggcacttgcacatgggttagtcgatcctaagagacgggggaagcccgtccgacagcgcgtccagcgcgagcttcgaaagggaatcgggttaaaattcctgaaccgggacgcggcggctgacggcaacgttagggagtccggagacgtcggcgggggcctcgggaagagttatcttttctgtttaacggcctgcccaccctggaaacggctcagccggaggtagggtccagcggccggaagagcaccgcacgtcgcgtggtgttcggtgcgcccccggcggcccttgaaaattcggaggaccgagtgccgtccgcgcc

SEQ ID NO: 25808 - DNA, 409 bp, Gossypium hirsutum
  Clone ID: LIB3272-054-P1-K1-H9
ggcaaagagacagagaccgatcattatactactacccaaagcaagacacgcactgaaactggaagacagcagacgatatgagggtgctacaagttttggcagtttccaagattctcacctcacacttgtctcgcacgcaccgcccctctgcctctcgtcagatgagtactgctgcttcttcgcttaaaaaatcccccatatttcgaaccctgggtctaataggagggaaatggattgacgcttatgatgccaaaactattcaagttaacaatccatccactggggaaattatagcagaggttccctttatgggcactctggagaccaatgatgccatttcttctgcgtctgatgcttttaattcttggagtaaactcactgctgctgagaggagcaaataccttagaaa

SEQ ID NO: 25809 - DNA, 430 bp, Gossypium hirsutum
  Clone ID: LIB3272-055-P1-K1-A1
caaaattctctcacgggttccactgcggttatcttcaaagtactagtaaaagattagaaggctaaagcagtgagagggggcgcagcaatcaaaaatcaaatcgaatattgcagagaagaatagagaggaaagagaaggaaatggctttaaatggaaatggttgctgttggattcaggagcgtattttaagtagaaatggatgtagtgtgttcctcactcccaggagtaggtcttctgctgccattttgccccgcaagtcaaccgctctctccttttcctcttcctttcaattccaaggatttgtggtggataggaagcagagctcctcctctatgcaaacggctgcagtccgccatttggtgggatctgttaccaaaactcaaggccttcgctttgctgtggttgtcgctcgtttcaatgagattgtgac

SEQ ID NO: 25810 - DNA, 167 bp, Gossypium hirsutum
  Clone ID: LIB3272-055-P1-K1-A10
cacactttcatttcttgttgaagtcaaacaaggaaaagaaaatcattcagctcagattcatggctacgcttatgacaaatctgctgctcacggcatgcattgctcttttcttggtatcagctggcaccgccggcggcgactcccccttcatcatcgctcacaagaag

SEQ ID NO: 25811 - DNA, 397 bp, Gossypium hirsutum
  unsure (1)..(397): unsure at all n locations
  Clone ID: LIB3272-055-P1-K1-A11
cgccgcagaccgtccggattccggtcgaccacgcgtncgccacgcgtccgaaacatccatttattcttttctttcaactcaaagtcccaagtagtattagaatcatgggtgttgtcacttataactatgactctacctcccctgtcgctcccgccaggcttttcaaggccttcgttcttgaagctgacaaggtctggcccatagctgcccctcatgcaatcaagagtattgaggttgaagctaatcctggccctggatgtatccgaaagatcaactttggtgaaggccttccattccaatatatgaagcaccagattggaggacatgatgaaaacaaattttcatacagttacaatttgattgaaagtgggcctttggggaacaagcttgagaaaat

SEQ ID NO: 25812 - DNA, 448 bp, Gossypium hirsutum
  Clone ID: LIB3272-055-P1-K1-A12
cccgaatcgccccacgcgcccacgcgtccgcccacgcgtacgcaatcatccatttattcttttctttcaactcaaaggcccaagtggtattagaatcatgggtgttgacacttataactatgactctacctcccctgtcgctcccgacaggctttgcaaggccttcgttcttgaagctgacaagggctggcccatagctggccctcatgcaatcaagagtatagcggttgtagctaatcctgcccctgaatgtatcgtaaagatcaactttgttgaaggccttccattccaaaatataaagcaccatattgcaggacgggaggaagacacattttcatacatgcacaattcgattgaaggcgggcctttggggaacacgcttgagagagtcaactacgagaataaatttgaggcatctgtaggtggaggaagtgattgcaagagctct

SEQ ID NO: 25813 - DNA, 289 bp, Gossypium hirsutum
  Clone ID: LIB3272-055-P1-K1-A2
acgcgtcggctgggcaagggccaggacccgtatgagtaggagggcgcggtggtcgtagaaaaaccctacgcgcgagcccggtcgtagcgagctttaatggagatctaggcgggcgtatcaaatatttaaaagagatctttgaatggggaatcgggcggtagatattaataactggagtggtggaatacatgttacgtcatcttaacttgactcaagttgggggggaccgctcaaggtgttgaaaagtttggggtagaatacaagcggttaaggacatttgcttttgttt

SEQ ID NO: 25814 - DNA, 340 bp, Gossypium hirsutum
  Clone ID: LIB3272-055-P1-K1-A3
cctgtaagtatcagtaggcgttagtatctccaggacttggttctgagctctaatcatctaactgggaaaatcccagctgagctaggtaactgcactagtctccggaaaatagaaatttatgatgaccttctaagcggtactatccctgctgaccgcgggaacttgactattatttaagctcttcgagctggggggaacaaacacattgtgggaagaatccctgatgagattggggactgcagccacttgactgcgttggggctagctgatacaagagttctaggttctttaccagcttcacttgggaagcgtagcccgctccataccttgtctatataca

SEQ ID NO: 25815 - DNA, 338 bp, Gossypium hirsutum
  Clone ID: LIB3272-055-P1-K1-A5
caattatccaaacgatggctatcttttcttcatccatggctgctatgctcattctagggctcctcactgcaaacttggatcctactgttgcgcaaattggtgtttgctatgggatgcttggcaacaatcttccaaatgcaagggaagtcatcaatctttacaaatcaaacaacatcaagcgaatgagactctacgatccaaatcaacaagcattacaagctcttagaggctcaaacattgaaattattttaggtgtcccgaatgatcaacttcaaaaccttgcttacccttccaaagcacaatcatgggttcgatcaaatgttgtagcctattggcca

SEQ ID NO: 25816 - DNA, 423 bp, Gossypium hirsutum
  Clone ID: LIB3272-055-P1-K1-A6
cacaaagaagaagaagaaaaaggaaacaaaagatggcaattgagattcctagagtgaaacttggaactcaaggatttgaggtttcaaagctgggatttgggtgcatgagtcttacaggtcacgatcattcagtgtcagatgaagatggcatagccatcattaagcatgcagtcgaaagaggagtcactcacatcgatacagccgacctctatggacccaaaactaacgaaattctggtcggaaaggcattgaagcatctgccacgagagaaggtacagttggctacaaaattcggtgttgaaagcatgggtccagatggtccggttatcaatggcactcctgaatttgttcgttcttcacttgaggctagccttcaacgcctcgatgtggattatattgatctttactatataatcagagttg

SEQ ID NO: 25817 - DNA, 388 bp, Gossypium hirsutum
  Clone ID: LIB3272-055-P1-K1-A7
ctccctctgagatcaaagcttcaaaatggcatttgtcaaggctcagaaaaccaaagcttactttaagcgggttcaggttccatacaagagaaggagagagggaaagactgactaccgggctaggattcgcctaatcaatcaagacaagaataagtacaacacttctaagtaccgattcggtgtccgatttagcaacaaagatgtcaccgcacaaataggttctgctaatattgctggtgatatgggtcttgcttctgcttacttacatgagcttacacgatttgggcttgaaggggggcttacaaactatgctgcagattattgcactggattgctgttggggcgccgtgtgcttaaaatgctcgaaatggatgatgagtatcaaggc

SEQ ID NO: 25818 - DNA, 294 bp, Gossypium hirsutum
  Clone ID: LIB3272-055-P1-K1-A8
gggggcaaggtcaaacaatcctgttatgatcatctctcgttggtttcaaaatgacgcttagccgcaagccaaattttcacaagctttcatggctatcaatccttgctgctgtcatgtcttttacttatgcttgcattggtcatggactgttcatcgctaaagctgcaagtggcggagaacatgtgacgacaagcttaactggtgtacaagtaggggtcgacgtctcaggctgttgaaaggtttggagaacattccacggtattggggacattggctttgggtatgcttactcca

SEQ ID NO: 25819 - DNA, 364 bp, Gossypium hirsutum
  Clone ID: LIB3272-055-P1-K1-A9
gttggattgaaaaggatagcattgaggaggaccaaatgatggctgctcggttggctaatacaatgggttactcactcaaggggaggcctatttagggtcgagtgttggaaggtaaagcgccaccccagctcattgcactattccaacccatggttggacttaagggtggtttaagccctggctccacgaatagtgtagctgacaaacgcctgccggatgaaacctataccgtaaagagtgttgctttaattcatattttcggcacagcttgacacaatattcaaacattgccaggtgttgcggcggccacatcattgaactgaactgagtgcttactcttgcaatctgggaccataatttttac

SEQ ID NO: 25820 - DNA, 424 bp, Gossypium hirsutum
  Clone ID: LIB3272-055-P1-K1-B1
gaatgttaacttcaagaatcatgtcattcagtggttcgaagtgcttgatgggttattgggtccatattggaaggcattaggacttgccttcaattgtactttcctcttatttggatctgtcatacaacttataggctgtgcaagtaatatatactacgttaatgacaaattggacacgaggacatggacctacatatttggagcttgttgtgcaacaacagttttcataccatcttttcacaactaccgtatttggtcttttcttggccttgggatgaccacttatacagcttggtacttggctattgccgccctcgttcacggccaggctgagggcgtgacgcatagcggtccgacgaagcttgtgctttatttcaccggagccaccaacattctctacactatcggcggacatgccgtcacc

SEQ ID NO: 25821 - DNA, 382 bp, Gossypium hirsutum
  Clone ID: LIB3272-055-P1-K1-B10
ctcacttctctttcttttctctttactcacccaattcttcactcttttgcttaaaagaatatatatcaattatagagctgatgggtggcataatatcaaaacgatcgaccacatcacagtcctcatctgtagcttctaattcatattcatgggattctcatagatatgcacagccatcaaatgctccctcaggccaagactatgttccagagcagcgttatgcccctccacatcacagttatggcagtcatgccccagagtcgaagaggaggttggagagaaaattttcgaagatagatgataactacaacagcttggagcaggtcaccgatgccctggcccgtgctggcctggagtcttcgaaccttatttgtggcattga

SEQ ID NO: 25822 - DNA, 411 bp, Gossypium hirsutum
  Clone ID: LIB3272-055-P1-K1-B12
agaatatctcatccttttattttcatttcgtcttcttttcagctcaaagtcatcatggaaattacttgtaggtatcaaaatggggacaataggcaaaactactacggccgctctttttctttggcttcttctggttcctattgtctttgccacgcctaatgacagattggttagaattggactcaaaacgagaaagattgaccgaaacaatcggatggctgcacaccttgaatccaaggagggaaaggcatctgaagcttttcttagaaagtatcgtcttcatgggaacttgggggaatcagaggacattgatattgtggcactaaagaactacatggatgctcagtactttggtgagattggtattggcactcctacacagaacttcactgtgatatttgacactgggag

SEQ ID NO: 25823 - DNA, 315 bp, Gossypium hirsutum
  Clone ID: LIB3272-055-P1-K1-B2
tcgccatcatgtttgagggaggtgtgggataagatgactgttctgctccttaaagaacgataccatgaggagacggtttttgatttgcattagcatgcgaataatggctgttcgttataaaccagaacctgctatatgtggtctcgaatacgcgcctactttgatttgtttgctcgcatatgatcttagtgataacaactcgggattatgaatgctcgcgctgtaatatgggttttatgaatccggttttgcaatcttcaagggagggtcatgctgaatatagaacgcctagcggtggaaggcttagccagaatt

SEQ ID NO: 25824 - DNA, 424 bp, Gossypium hirsutum
  Clone ID: LIB3272-055-P1-K1-B3
gctgctgaagctaacaaggacaagttgtccgctcttatggttacttatccttcaacacatggagtgtatgaagaaggcatcgatgagatatgtaagattattcatgacaatggaggtcaagtttacatggatggggctaacatgaatgcccaggtcggtttgacaagtccgggttttattggagccgatgtttgccatctgaatctccacaaaaccttctgcattccacacggaggtggtggacctggcatgggacctattggtgtcaagaagcatttggcaccatttttgccttcacaccctgtggtacccacaggaggtatcccagccccagaaaaatcagaccctcttggtaccatttccgctgcaccttggggctctgcacttatcctgccgatatcttatacttatatagccatgatgg

SEQ ID NO: 25825 - DNA, 368 bp, Gossypium hirsutum
  Clone ID: LIB3272-055-P1-K1-B4
gctggtggggctacaaaggactaggaattcactttgctactccttagaacaatacattgtaccttgtttgagctagggaaagagcaatctgtggtgaggtagaaccacaaggggccaattttgacagggaagatcacaatttatcaaatctggtacagataggtgtacccaacccagcggtccataatacatgattttatcaactctgtgagctctgtcgtataaaacaaaattatgtcgggacacttttggtgacaaaccccagggaaaaacaagtacgggtcctgcactttggatgagggcaaacaacttctccttgcaaatacagcgctcggtaaaacccttaataacgcacacttgtcagcgac

SEQ ID NO: 25826 - DNA, 420 bp, Gossypium hirsutum
  Clone ID: LIB3272-055-P1-K1-B5
gaaaaagaaaaagtgggttttatttttcgatgaaaatgagtaaagcatcaattgttttactctattttggcttcatattcatccattgtgaagctaaatcgatcagagaaaagcctcaagcttttgagtccttcaatgtcagttatatacagaatttagggagctgttcttactcggtggtttttacaacgagctgttcatcaactagttacactcgagatcaaatcagtattgctttcggtgatgcctatggtaaccagatatatgtgccgaggttggatgatccagcgtctagggcatttgaacaatgttcttcagataagtttgagattaaaggaccatgtgcgtatcagatctgctatgtttatctctaccgaactggaccagatggttcgaagccggagcatgtgaagatttatg

SEQ ID NO: 25827 - DNA, 410 bp, Gossypium hirsutum
  Clone ID: LIB3272-055-P1-K1-B6
gcgaaggaagcgactttcaacttcgaagaggaagacttgttaaatgaaagaagctgtgaaagtgagatagagatgttgaggttcacattatattattgggtgttaatatttattttaattccatctgcttccttcgttattgtatcatcatcgaaagaacagctaagttcaaagcaatgtgaggatctgggtttcacgggtttagccctttgttctgattgcaacactttttctgagtatgtcaaggacaaagagttgatatctgactgcttgaaatgttgcacagaagactcagatgattctacaagtaagattacttattcaggtgccaatactggaagtttgcatgaggaaactagtattctatccggaaattgttggtttcattgaagaagagaaggacaagtttc

SEQ ID NO: 25828 - DNA, 330 bp, Gossypium hirsutum
  Clone ID: LIB3272-055-P1-K1-B7
ccatcatgtctgagggtgttgtttgaaatgatgatggtttgcagcctagatttcaaaaaactgtatgccgcgtggaagacctcctataatggatctgaaaacagcttatgatgctgaactcagtggatctagaattcagcatgaactatggccattagatgaaattgctccggggaaagcaaagttttcttgctggctggtttggaccccactcccagttgtctaatggttggcaccttctcattggccacgttggcatttgccgagaagctggcccgattctggactgttcaggatcatattttgcgaatgtcacggattttgtttttg

SEQ ID NO: 25829 - DNA, 408 bp, Gossypium hirsutum
  Clone ID: LIB3272-055-P1-K1-B8
tttctcctttttatctttaaaacacgcacccaaaaaataaaaccctttgaaaaccgaagatggaagaagaagatgtcgtggcatgcttatgtagatgatcacttgatgtgtgaaatcaaaggaaaccatctctctgccgtcgctatcatcggccaggacggcagcgtttgggcccaaagcgccagtttcccttagctcaagcctgaagaaattagtgccatcatgaatgactttaatgaaccgggttcactcactccgaccgggttgcacctgggaggcacaaaatacatggtgatccaaggcgaaccgggagctgttatccgagggaagaaaggacccggtggtgttactgttaagaagaccaatatggccttgattatcggaatctatgatgaaccaatgacaccc

SEQ ID NO: 25830 - DNA, 323 bp, Gossypium hirsutum
  Clone ID: LIB3272-055-P1-K1-B9
cccgttcgagctaacaaggacaagttgaacagtctaagggttacttaaacggcaacggatggtgcaactgctgtggggatcgatgagatatgcatgattattcatgccattgggagctaggactacatggagggggctagaccctatgtccagccttaccagacaagtacgggttatattggagccgatacttgccatatgaatctccacaaaaccttctgcattccacacggcggtgggggacccgtcatgggacctattggtgctaagacgcattgggcaccatttatggcttcacaccgtgggggctccacaggaggggt

SEQ ID NO: 25831 - DNA, 417 bp, Gossypium hirsutum
  Clone ID: LIB3272-055-P1-K1-C1
tccatcccctctccctgctttgctctgaaaagtccaagtttttctccaatggcgaccgtctctccaactcctctgttgaaagatgagctcgacatcgtgattcccacgattaggaacttggactttttggagatgtggagaccctttttccagccttaccatctcatcattgttcaagatggtgatcctaccaagactatcaaggtccctgaaggcttcgattatgagctttacaataggaacgacatcaacaggattttgggtcctaaggcttcttgtatctctttcaaggattctgcttgtaggtgctttgggtacatggtttccaagaagaaatacatctataccattgatgatgactgctttgttgctaaagatccatctggaaaagacatcaatgcattggagcagcacata

SEQ ID NO: 25832 - DNA, 356 bp, Gossypium hirsutum
  Clone ID: LIB3272-055-P1-K1-C10
gtgtccatcgcgtggctttcctatcttcatttcttcacactctccgacgaaagaaaccagagaaaaatgaccaagtgttacccaaccgttagcgaggactaccaaaacgccgttcaaaaggctaagaggaagctaagaggtctcatcgctgagaagaactgtgctccactcatgctccgtctagcgtggcactcagctggaacttttgatgtcaagaccaagaccggaggtccattcggaaccatgaagcaacctgctgagctcgctcatgctgctaacaacggtctcgatattgcagtcaggcttctcgagccgatcaaggagcagcttcctatcctttcatacgctgacttcta

SEQ ID NO: 25833 - DNA, 384 bp, Gossypium hirsutum
  Clone ID: LIB3272-055-P1-K1-C11
gatgaagtagcagtgaaaaggctgtcgagacaatctgggcaaggttgggatgagttaaagaacgaagcaattctaataggcaaactccaacacaaaaacctcgtcaaagttcttggttgttgcattgaaagagatgaaaagattcttatctatgagtatttgcccaataagagcttggatactctcctctttggtaccaatgcaatggttacactaccttggaaaactcgagttcgaatcatcgaagggattgctcaaggtcttctttatctccatcaatattctagggttcaaattattcacagggatttgaaggccagcaacattttgttggatgaagatatgaaccctaaaatttcggactttgggatgggctagaatttt

SEQ ID NO: 25834 - DNA, 332 bp, Gossypium hirsutum
  Clone ID: LIB3272-055-P1-K1-C12
ggttaactttccttcctagtcttccacttcaacaatgggtgagaaatgaataatcccactaccgacactgtctttcgtgtaaagcttcagacataccattaaagggtacagagattgagggaaaactacttgtgggacttcaaccccccctccccccccccaaaaaaaaacctgttttttctctttctgtctctgcaataaactggaaggagcagacacagagacagggagagacagatagagagagagaggtgtaggggagacagtatggctaaattaatctaaagataagatttgatccatctctcttatggtttcctttttctttggat

SEQ ID NO: 25835 - DNA, 135 bp, Gossypium hirsutum
  Clone ID: LIB3272-055-P1-K1-C2
aacccaaccaggaggcagaattttggttaggatttgaaccgcgaggacgatcactctggaggtctagagcttccatacgatcgcaaacgtgagggccaaaatgcaagaggaggaaggggtccctccagaccagcg

SEQ ID NO: 25836 - DNA, 170 bp, Gossypium hirsutum
  Clone ID: LIB3272-055-P1-K1-C3
gaagtttcttttttcgattttctatttagccaaccaggatgcaaattttagttaggactctgaccggcaggacgatcactctccaggtcgaaagctccaattcgttccacaagatgaagaccagaatccaaaagtgggaaggctattctacaaaccagcggagagtgatt

SEQ ID NO: 25837 - DNA, 411 bp, Gossypium hirsutum
  Clone ID: LIB3272-055-P1-K1-C4
tttctatttagttttctcttcctccaattaagatgcagatcttcgttaagaccctgaccggcaagaccatcaccctcgaagtcgagagttccgacacgatcgacaacgttaaggcgaaaatccaagacaaggaagggatcccaccagaccaacaacgtctcatcttcgccggaaaacagctcgaagatggccggaccttggccgattacaacatccagaaggagtccaccctccatctcgtcctccgtctacgtggtggcatgcagatcttcgtcaaaaccctgaccggcaagaccataactttggaagtcgaaagctctgacaccattgacaacgtcaaggccaagatccaagacaaggaaggcatcccaccagaccagcaaaggctcatctttgccgggaaacaactcg

SEQ ID NO: 25838 - DNA, 422 bp, Gossypium hirsutum
  Clone ID: LIB3272-055-P1-K1-C5
ctcttctctcctaacctttcctttcgcttggagagtcggatgggaggtatatcgcttgttttcaagatcttcaaattcaatttcaaatttgaccatccaaatatttatttcttgtcaaatcgaaatttctaacccattaaagggggaaagggaaaatgtcatcatacgaaaacgttgttggtgggaagctgaagctcaagggaaaagccttggatgttaaggctggtggaatcaagaagaaaaagaaacataagaagcagattcaacatgatgaccaaattacccagaacgatccctctgatgccgcttccgctggtgaaaccacagaagtttctgttgatcccaatgaagaagatatcaacaatgcggagatgtcaagtggagagaaggcggctcctcattatgatgattatcttacccca

SEQ ID NO: 25839 - DNA, 406 bp, Gossypium hirsutum
  Clone ID: LIB3272-055-P1-K1-C6
gcttttccctttccttgctttcgctggattgttcttcctcttccgtcgggctcaaggtggtccaggtggccccggtgggcttggcggacccatggattttggacgatccaaatccaagttccaggaagtgccagagactggtgttaccttctctgacgtagcgggagctgaccaggcaaaattggaactccaagaggttgtcgatttcttgaagaacccagacaagtacacagctttaggagctaaaatcccgaaaggttgtttattggttggccctcctggtactggaaagactctattggcgagagcagtagcaggagaagccggggttccgtttttctcatgcgctgcttctgagtttgtggagttgttcgttggagtaggtgcatccagagtaagggactta

SEQ ID NO: 25840 - DNA, 320 bp, Gossypium hirsutum
  Clone ID: LIB3272-055-P1-K1-C7
aattgacccacgcggcccacgcgtctcggtttcattgtttatcagagcaacgaaaaagaagggaaaatggaagggaaagaagaagatgttagattgggagctaacaagttctcagaaaggcaacctattgggacagcagctcagtcccaagatgataaggattacactgagccacccccagcacccttgtttgagcctagggagttgactttatggtcgttttaccgagctggaatcgctgagttcgtggctactacactattctcgtacatctcagtgttcactgtgatgcgagtccttaaggacatatccaaggtgta

SEQ ID NO: 25841 - DNA, 398 bp, Gossypium hirsutum
  Clone ID: LIB3272-055-P1-K1-C8
ccaccgccgtcgatctcgatccttatcctcgttttcaaacaagctcgaaaaagatggccaacgctgcatcgggaatggctgtgcatgatgattgcaagttgaagttcttggagctcaaggcaaaaagaacccaccgcttcattgttttcaaaattgaggagaagcaaaagcaagttattgtggagaagcttggtgaaccaaccgaaagctatgaggattttactaaatgtctccccgctgatgaatgtcgatatgctgcgtacgattttgattttctaacggccgagaacgtaccgaagagcagaatctttttcatagcatggtctcccgacacgtcaaggatcaggagcaagatgatttacgccagctccaaagatagattcaagcgagaactggat

SEQ ID NO: 25842 - DNA, 417 bp, Gossypium hirsutum
  Clone ID: LIB3272-055-P1-K1-C9
ttcagaatctgacaaaaggggggatgctgctttaggatttttgggcatcactcctcccttagcggaagcagttaaaagcaaaggagaagctaagcctgataccgaaggagttcaacaagatgttgaaagtgatgagtctcattctaagagtcttcggagagaatctgggtttgttgagttcataagccctgaaggagaggttttcatctgtagtactgatttagaaatgggctcctgtcaacatcaggatgcattaattgaacttggttgttcttgcaaaagtgatcttgctctagtgcattatgctcgtgctctcaaatggattgttagtcatggatctactgtttgtgagatctgtggaaatcctgcaaaaactatcaggacttctgattataagaaagttgtagtttctttgaa

SEQ ID NO: 25843 - DNA, 425 bp, Gossypium hirsutum
  Clone ID: LIB3272-055-P1-K1-D1
gcattctccatgctgtaggccagatggaaatgcgatctgatctcatggatgctcatatgtatgcattcaagaggtctgtcctgcaagaagttttagacataaaggatacgtttcaaagcttgaaagaggatgtacttccttatcttgtccggagccagctgaaatccgaggccttactaaatagaacaccgcaaggtgaagaaaacagtaacgagaaggttagttcccagaacaatcaagcattcatctctcgaatccttgctaacgcatctaccccaagctttcacggactctattctgagaatcccgatggttcttcttctactcggaaaacccataaatgctgtgtttatattgcaagcagcagcagttattgtgtgcgcttaaattccattcaagcttttatggacataaatcgatatgtc

SEQ ID NO: 25844 - DNA, 412 bp, Gossypium hirsutum
  Clone ID: LIB3272-055-P1-K1-D10
aatacaaagagcaggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttgtgtttttgatgctctttatgtctccatatcaaggagaggttactcaggtgcaccgccggcggcagtgacggctagctttggtaggcctggaacgatggggaaaggggaacgaagatatgccatgaaagaatcgtcgtcgtccgagacaagggcttattttttaagttgggcccctgacccttgtaccgg

SEQ ID NO: 25845 - DNA, 367 bp, Gossypium hirsutum
  Clone ID: LIB3272-055-P1-K1-D12
cagagccaaagcccgaggagaatacagcgaaagtggagaactcctcatctttgtctacggttcaatccgagagtgagggttcggctgtatcttcacctttatcagatcttacattctcggatttcgacgaacagccatggccggaagtcgtttcttcttccgaaacttttatgttgaccaagtacccttctgacgatcgattgggattccatctaaaagcctgaagggaaaaacccatgtgtacctttctgtgtaagtcttttgatgtttaggaagctcctttcatgtatttgggtgtattttgtaaagctagctgcaatggggtttttggcagttgcaggggcctgtattttaggttattaaaagt

SEQ ID NO: 25846 - DNA, 419 bp, Gossypium hirsutum
  Clone ID: LIB3272-055-P1-K1-D2
gcgctttgctttctctctctttttatggatgggatcatctcctttccttctccttcatgaaggctacgatttgaagactgtttttgatttccattagcatgcgaattaggccttttcgttataattcatcgcctgaaatatctgttatcgaatacgcttctacttttttttgtttcctgattttgattttagtgataacaactggaaattttgaatgctcgagctgtaatatgggatatttgaattcggttttgcaatcttcaagtcaggttcatgctgaatatggaccggttagcggcggaggccttagccagaatggaaagtttagctacggctgtgcaagctctcctggaaagaggtcttcaatggaagatttttatgaaacaaggattgacggtgttgatggagagatagttggt

SEQ ID NO: 25847 - DNA, 382 bp, Gossypium hirsutum
  Clone ID: LIB3272-055-P1-K1-D4
cacctgcatcaatgttgatgaaggttgatcacatcttaaacctatttcgctatgattgccatatatatgtaaaattgcgccgaaagcacatatcttaggaagtgaagcactgaaaactctgaaaagtttcatagctttttcatctctataatagcgtacgcttttgtgcccattcgcaatgcatagaattgtatcgcaaagagaaatcagaagcagagctccccacaaggctctttcttggttcagttcttctaagctttttaggaatgtcattctttaccttttgcaagctgagaagccgacgggatctcgacttgtacacctgctaaagtacaaaactagacgcaaggtgaatggacgggatctcgacagggcacacact

SEQ ID NO: 25848 - DNA, 420 bp, Gossypium hirsutum
  Clone ID: LIB3272-055-P1-K1-D5
aaaaaaggttgtaaaaaactcagcagcgccactgtccctaatgtgaaaatcttctgggacctttcaagggcaaagttcggatccggacctgaacccgactctgggttcttcgttgccgtcgtcgtcgacggtgaaatgacgattctcgtcggcgatgctaccaaggaagcttatactcgaactagagctcaaaaccctgggagtagaagcagcccaactcttgttttgagaaaagagcacgtgttggggaacagagtttacagcacataagccagattcggaggcaaattaagggatatctcgatcgattgtagggtaaacgaggatgcgcagctgtgtttgagcgtggataacaaaagggtattgcaaataaagcggcttaaatggaaatttagagggaatgagaggattgaagtggat

SEQ ID NO: 25849 - DNA, 367 bp, Gossypium hirsutum
  Clone ID: LIB3272-055-P1-K1-D7
gaaaaagaaaaagtgggttttatttttcgatgaaaatgagtaaagcatcaattgttttactctattttggcttcatattcatccattgtgaagctaaatcgatcagagaaaagcctcaagcttttgagtccttcaatgtcagttatatacagaatttagggagctgttcttactcggtggtttttacaacgagctgttcatcaactagttacactcgggatcaaatcagtattgctttcggtgatgcctatggtaaccagatatatgtgccgaggttggatgatccagcgtctagggcatttgaacaatgtttctcagataagtttgagattaacggaccatgtgcgtatcacatctgctatggtta

SEQ ID NO: 25850 - DNA, 87 bp, Gossypium hirsutum
  Clone ID: LIB3272-055-P1-K1-D8
aaaaaaaaaaaaaaaaataaaataaaaacaaaaaaaaaaaataaaaattaaaaaaaagatactataatgaaggctgaatataaaggg

SEQ ID NO: 25851 - DNA, 416 bp, Gossypium hirsutum
  Clone ID: LIB3272-055-P1-K1-E1
ataccagatctgttacactctgaattatttaagcagcacgtcacaagggatctagagcaaggttagtgaccttgggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcgaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaagtaca

SEQ ID NO: 25852 - DNA, 343 bp, Gossypium hirsutum
  Clone ID: LIB3272-055-P1-K1-E10
cttgttgccggtactcctttgcgccacctaccatatcgctctttccgcgaccaacgttacggtggcggacgggctgttagataatggtaactttgagcaagccccgaatgccttaaacctgaaaggcactgttgttgtggggcgttatgcaataccaggatgggtaaacgaagggtttgtggaatacataaagtccgggcaaaagcaaggggacatgttgctggtggtgcctgagggagcctatgcagtcaggttggggaacgaggcttcaatcaagcaggaaataaaggtggcgaaagggatgtattactccattaaccttagtgctgcccgtacttgtgct

SEQ ID NO: 25853 - DNA, 248 bp, Gossypium hirsutum
  Clone ID: LIB3272-055-P1-K1-E12
gacgaatggagggtccttagctttctcttttaaattaaaaaaaaaaatcacacataaaaatatttaaaaaaaattaaactttggacaaatttcaaagattgtggttttcttctgcaatttctcatccaccaattgaatcacgttgggaagcattgagggtgtttattatttggtggttttttataaccactgatgttttcgccactgatcggcgtgtgagaggaagggattcagagcaatgatacttt

SEQ ID NO: 25854 - DNA, 185 bp, Gossypium hirsutum
  Clone ID: LIB3272-055-P1-K1-E2
gcgaaaacgcgtacctctatatgtgtgagaaattcgacgcaacacatggcaacataccaggcatagacattgtaaggctcgaccgcctgctaactcttttttgtttatatacgcggtgcaagatggacaaaaccagtttgttgctccttctggtgggctaacctctttgacgagcgctacaaccc

SEQ ID NO: 25855 - DNA, 329 bp, Gossypium hirsutum
  Clone ID: LIB3272-055-P1-K1-E3
gagccagatgagtaggagggcgcgatggagcgtaacacaatctgatgctcgagccgcgtagcggagcgtcgcattgtgactgtcttgcacagggccgtacttattcgactcagagcaaggcctgcttatatatgctaaagggatcctaggacacactgcagctgtgcattttgctgtggcattgagctaaagcttgcactgaatataatgaccacagggctggctctatgagggattttcagactgaagaacgcactatgtatcaccagcattggctttctacagtgttgaaggaaagatataatgtgagaactatcaaggaaacactt

SEQ ID NO: 25856 - DNA, 383 bp, Gossypium hirsutum
  Clone ID: LIB3272-055-P1-K1-E4
aagctgcctcctccatggcttcagctccttccaagctctatgcagatgatgttagccttgtggtagttttgctggacactaacccatttttctggagctcctcctcactctctttctctcagtttctctcccatgttcttgcgtttttgaatgcgatattgactctgaatcagctaaaccaagtcgtggttattgctactggatataattcctgtgactatgtctttgattcgtcttcagatttgaaccggagttttgagaatgggagaatgcctgttatgtgctccagtttgttgcagaagttggaggaatttcttattacagatgagcagttgagcaaggaggaacctgaaggaaagattaagccttcccttttctcgggg

SEQ ID NO: 25857 - DNA, 420 bp, Gossypium hirsutum
  Clone ID: LIB3272-055-P1-K1-E5
gtcgagccgaatcgcaaccatcaaggatcatccgcgaaatttcactctatggcacccataaagggcattctttccttgcaaagggcatctttgttaagagcttgcggtgaaaggtggaaactaggcactagatcatttagtactcaaggagcaacaactgctgatgctccacaggcacctgctgctgctccaccgcctgaaaaaacccattttggtggtctaaaagatgaagaccgtattttcaccaacttatatgggttgcatgacccttttctcaaaggtgccatgaaacgtggtgactggtatagaaccaaggatttagtactcaagggtgctgattggattgtgaatgaaatgaagaaatctggacttcgaggacgtggtggtgctggatttccatcgggcctcaaatggtctttt

SEQ ID NO: 25858 - DNA, 421 bp, Gossypium hirsutum
  Clone ID: LIB3272-055-P1-K1-E6
cggcatcagtctcagcaggcggggaagaatgtctcacaggaagtttgaacacccaaggcatggttcccttggatttcttccgaggaagcgagcttctcgtcacagagggaaagtgaaggcatttcctaaggatgacccaagcaaaccttgcaagctcactgcctttttgggctacaaggcaggcatgacacacattgtccgagaggtcgaaaaacctggatctaagcttcacaagaaagagacatgtgaagctgttacgatcattgaaacccctcctatggtgattgttggggttgttggttatgtcaagacaccacgtggtcttcgcagcttgaacaccgtttgggctcagcatctgagcgaggaagtcaaacgtaggttctacaagcattggtgcaagtacaagaagaaggctttcacc

SEQ ID NO: 25859 - DNA, 393 bp, Gossypium hirsutum
  Clone ID: LIB3272-055-P1-K1-E7
attgttccttccttcgccgtctactgctcttgtgacctcgatttcaagtgaaacagaatgggtaaggaaaagactcacattaacattgtggtcattggccatgtcgattccggaaaatcgaccaccactggccacctgatctacaagcttggtggtattgacaagcgtgtgattgaaaggtttgagaaagaagctgctgagatgaacaacaggtcattcaagtatgcttgggtgcttgacaagctcaaggctgaacctgagcgtggtatcaccattgatattgccttggggaaatttgagaccaccaaatactactgcactgtgattgatgcgcctggacaccgtgactttatcaagaacatgattactggtaccttacaagctgactgggct

SEQ ID NO: 25860 - DNA, 168 bp, Gossypium hirsutum
  Clone ID: LIB3272-055-P1-K1-E8
ggctacaacaagtcgccggttcaatggatcacaaaataactttcttctcctgtagacggacgaggcctaatgctaattagactggaccgtggcataacctattgaaattagaaagcgcggggccaaaaagccaaaaggagttccaggatccacttgggggtgtacctt

SEQ ID NO: 25861 - DNA, 345 bp, Gossypium hirsutum
  Clone ID: LIB3272-055-P1-K1-E9
cacaaacccaaatctccaattgatctgtttcatttttcagcaaagctagaaaaacaatgactaaggatatcgagactgcagagcaacatggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatcttta

SEQ ID NO: 25862 - DNA, 361 bp, Gossypium hirsutum
  Clone ID: LIB3272-055-P1-K1-F1
aacgctagcacgagcagtgctgaggaatttgttcctcatacgacccgtaaaacagaattgaagttgaacattgcaaatccgactactggttgccaaaaaatgctggaaattgatgatgaccataaactttgcgccttttttgacaagaggatctcacaggaggtcagaggtgatgccctcggtgaggaggttaagggctatgtattcaatatcatgggtggctgtgatgaacagggttttgcaatggagcatggagttcttactcctggacgtgttcatgttttgctttacagaggtacttcgtgtttctctgggtatggtacgagaaatggatagcgcaagatgaagtcaattcggggat

SEQ ID NO: 25863 - DNA, 377 bp, Gossypium hirsutum
  unsure (1)..(377): unsure at all n locations
  Clone ID: LIB3272-055-P1-K1-F10
ctaaaacttgcaccggtctgtggctagctctagaagatgcaacagttgtaaacggctgcctttgggccattcctgaatctcaaaaaaatggtcttgttagaaggttcattaggggtgatgatggagtttactttgataggccgtccctatcatatgaccagaaagattttgtgcctattgaagtaaaagctgggtctttggttgtaattcatggtgaccttattcatcaaagttttgaaaatcaatcttcaaattcacggcatgcatacagcttgcatgcggtagatactgatggctgcaagtgggcagaagataattggatccgaagaaaagttgaacctgagcccctttactcttctggacagactngagagttt

SEQ ID NO: 25864 - DNA, 99 bp, Gossypium hirsutum
  Clone ID: LIB3272-055-P1-K1-F11
tcgtagaaatcttatctcttcgaccctgaagcaggctttaagactagtgaacactgtgcattgaaaaacttcggaagcccccacgggaatggggtcgtc

SEQ ID NO: 25865 - DNA, 312 bp, Gossypium hirsutum
  Clone ID: LIB3272-055-P1-K1-F2
acggaagattggagtttgcttctttttttttaaacaaaagaaagggaggaaaaccagcccttctttaacccatccgcgcccggaaggggcttgccaagaaacttaaggggggaaccaaaaatgccccaacccggctgccattaattaacctttgggccatggctttggttggcctcctggtggggtggttgctttttgatagaaaaaggtggattaggctttgaaagatattttggtttcaagttggtgatttaggatggattacactcacctaccaaaggattttggggctccatcccaggttgggaattt

SEQ ID NO: 25866 - DNA, 402 bp, Gossypium hirsutum
  Clone ID: LIB3272-055-P1-K1-F3
ctcacttctctttcttttctctttactcacccaattcttcactcttttgcttaaaagaatatatatcaattatagagctgatgggtggcataatatcaaaacgatcgaccacatcacagtcctcatctgtagcttctaattcatattcatgggattctcatagatatgcacagccatcaaatgctccctcaggccaagactatgttccagagcagcgttatgcccctccacatcacagttatggcagtcatgccccagagtcgaagaggaggttggagagaaaattttcgaagatagatgataactacaacagcttggagcaggtcaccgatgccctggcccgtgctggcctggagtcttcgaaccttaattgtggcattgatttcactaagagcaatgagt

SEQ ID NO: 25867 - DNA, 414 bp, Gossypium hirsutum
  Clone ID: LIB3272-055-P1-K1-F4
ctcgccggcgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaaca

SEQ ID NO: 25868 - DNA, 157 bp, Gossypium hirsutum
  Clone ID: LIB3272-055-P1-K1-F5
gctactcttcggttcatccgaaaggaatttaggaccaatgttttctttgctatttgatcatacacattttgtggagtttgttgcactgtaatactgaaattttcattcaagcttgtaacattatggaatcctgctctcatcaaacatataattctac

SEQ ID NO: 25869 - DNA, 417 bp, Gossypium hirsutum
  Clone ID: LIB3272-055-P1-K1-F6
gaaaaacaaacaaaaatgcctttaaggcactcattgctgcagaatatagtggtgtgcatgtcaaaatggttgagaattttgagatgggtgtgtcaaataagactcctgagttcatcaagatgaaccctttggggaaggttcctgtgttggaaacacctgagggtccggtatttgagagcaatgccattgctcgttatgttgctcgctcaaaggttaacaaccctatatgtggttctacattgattgattatggtcatatcgagcaatggattgattttgcagccttggaaatggatgctaatattgccaaatggttgtatccaaaacttggttacggtgtttacctttctccagctgaggaagctgctattgctgcattgaagagagcccttggcgctttgaacactcatcttgctt

SEQ ID NO: 25870 - DNA, 373 bp, Gossypium hirsutum
  Clone ID: LIB3272-055-P1-K1-F7
cgccgtctcgcctctcgcttattggttcaagatctggttttgatctgatcagatcgtataaaaatatcaaaacatgtttgggagagcaccgaataaaagcgataattccaaatactatgagattttgggagtatcgaaaaacgcttgccaagatgatctaaagaaagcttatagaaaagccgctattaagaatcatcccgataaaggcggcgatcctgaaaagtttaaagagttggctcaagcttatgaggtgctgagtgacccggagaagcgtgagatttatgatcagtatggtgaggacgcccttaaagaagggatgggcagcggtggcggtggccatgaccctttcgatatcttccagtctttctttggt

SEQ ID NO: 25871 - DNA, 338 bp, Gossypium hirsutum
  Clone ID: LIB3272-055-P1-K1-F8
ctttgactgagctgatccaatccagtggtaacgcagacagaaaatggattcaagagaagacgacggcggagagccacttagccggatggcggagtggcgtgatgtgacgcctcttcctcaagacgacggtcctaaccccgtcgtgcccatcgcctacaaggaagaatttcgtgaaaccatggattacttccgggccatctacaaagccgatgaacgctcccctcgtgccctacgcctgacccgacgagcaatccatctcaatcctggcaattacactggttggcattttaggcgactcgtgctccaagcacttaatgccgatttggacgatgaattgg

SEQ ID NO: 25872 - DNA, 353 bp, Gossypium hirsutum
  Clone ID: LIB3272-055-P1-K1-F9
gtgaactgaaaaaagaaaacccggaattttaaagacaaaaaaatgccttcttctccgttgattcttctctcaaaaaccatgattttcccagaccaaaaatcaaaccttgaagacctcaagctttcaggttccgatcttcctatgctatcttgccattacattcaaaaaggttgcctctttactcgcccttcaatccccattaattcactgatttcccttctcaaacaatccttgttcaagacgctgtcgtttttccctcctctcgccgggcgtttttacacagacccaaatgggtacaattacattacttgtaacgacgccggcgttgaattccaccatgccaaatgtgacac

SEQ ID NO: 25873 - DNA, 400 bp, Gossypium hirsutum
  Clone ID: LIB3272-055-P1-K1-G1
atcatcatcactctccccacccaccaacctttcccaacacaaaaacaaagcagctgtttttactagttttgattgtgagagagagagaggatgagagtgagtgtaaattatgcgaatcctttgtgacgcttgtgaaagtgctcctgctattgtcttctgtgctgctgatgaagctgctctctgccattcttgtgatgaaaaggtccatatgtgcaataagcttgctagccgtcatgtccgtgttggactagcaaatccaagcgctgttcctcgttgtgacatatgtgaaaatgcacccgctttttttttattgcgagatagatgggagttccctttgtttacaatgtgatatgattgtacatattggtggtaaaaaaacacatggaagataccttttttt

SEQ ID NO: 25874 - DNA, 411 bp, Gossypium hirsutum
  Clone ID: LIB3272-055-P1-K1-G10
agcgtttgtctcagatttttgaagatggcccgtaccaagcagacagcccgtaagtcgactggtgggaaggctccaaggaagcaacttgctaccaaggctgcccgtaaatctgccccaaccaccggtggtgtgaagaagcctcatcgctaccgtcctggaactgttgctcttcgtgaaattcgaaagtaccaaaagagtactgagcttcttatcaggaaattgcctttccagaggcttgttcgtgaaattgcccaggacttcaagactgatttgcgtttccagagccatgctgttctagctctccaggaagctgcagaggcataccttgtgggtctttttgaagacaccaacctttgtgcgatccacgccaagcgtgtcacaattatgcccaaggacatccagttggctcgt

SEQ ID NO: 25875 - DNA, 419 bp, Gossypium hirsutum
  Clone ID: LIB3272-055-P1-K1-G11
gggacgcgtgggcgcttaacttcgcgcgattgctagcttcatcttctctgttcgaccttcccaaaaaaaaaaaaaaaagaaaagaaaaattcaggttgggagtattacacagctttgttttggttaactccttttcgtccaccatatttgcccccaatatgaagatcttgttctcgaaagttctaacgaacaccgatgtacagaaaagatgggcggttcccaacaattcactgaagcatttcgagcttgaaaatggtaattgctccaaatcatttgaagttaaagatgaaaacggattcacatggccttttcgttgctatgttcgtaacgacggtgcctacaagaagcctgttttatccagcgggtggcgtcaatttgtccttaataaaggagttcaccagggggatttgattacactt

SEQ ID NO: 25876 - DNA, 368 bp, Gossypium hirsutum
  Clone ID: LIB3272-055-P1-K1-G12
gtgtaggataagtgggagctctcgggcgaaattgaaataccactacttttaacgtgattttacttattccgtgaatcggaggcggggcacggcccctctttttggacccaaggccggcttcggccggccgatccgggcggaagacattgtcaggtggggagtttggctggggcggcacatctgttaaaagataacgcacgtgtcctaagatgagctcaacgagaacagaaatctcgtgtggaacaaaaacgacatccctgttaagacactgttgacggttattgaaggagagcaatctgatggagatgtgctgattttccctgaaatgatcaaatacaagggtttgactgaaggtgatgtggatggct

SEQ ID NO: 25877 - DNA, 273 bp, Gossypium hirsutum
  Clone ID: LIB3272-055-P1-K1-G2
gaaaaaaatgattctcccagtttgttacttttctctttaatctacgtgactctctctcttactgttcctttttctttgccgatctcctgtattctgaatctcaaattagctgagtactggtaggaaattatcaaatccgaggcaccatggaagccgacgacaagtttttgaacatgggtattctcatagtagccactctagtaggggccaaactcatattggtcctcataatgcccaaatctaagaagcgggtgcccgcagtaatcaaaagct

SEQ ID NO: 25878 - DNA, 356 bp, Gossypium hirsutum
  Clone ID: LIB3272-055-P1-K1-G3
gtttctttcaatcgaagaagaaagctagcaattaagacggtggcgtagaggaaaatgttcaggaaccagtacgatacagacgttaccacatggagtcctgcggggcggttgttccaagtggaatacgcgatggaagctgtgaagcaaggttcagccgcgatcgggcttcgatctaagacccatgtagttttaggttgcgtcaacaaggctaactccgagttgtcttctcaccagaaaaagattttcaaagtcgacgaccacatcggcgttgccatcgccggtctcaccgctgacggccgcgtcctttctcggtatattagaaatgagtgtattaactacaacttcacgtatgaatc

SEQ ID NO: 25879 - DNA, 379 bp, Gossypium hirsutum
  Clone ID: LIB3272-055-P1-K1-G6
caagttttgaggtagaaaacaagagaccatggcaagagggcgaaccattctgacttgtctcatgtggcttttactcgttttctccattactttgtgtgcaagtgcaactgccggttctgtctgggaacatcccaacaagttgtttatccccaagggtgtcgctgctgctatttcgttgggaaacctttcatgcttcggtgtggcaaagtatgctgcgatgatgattgctgttagctatgttagcatgagatttaaggttgaatcattatgtgcatcatcttttttcccctttgatgaatgtaatgtaattgtaccaaataaaaaataaaaataacgcttatccaattaaaactgaagaaaacaaaggttggtttaatta

SEQ ID NO: 25880 - DNA, 328 bp, Gossypium hirsutum
  Clone ID: LIB3272-055-P1-K1-G8
catctactgcttctctcatggcttcttgcttggctccggtttccatctcaggtggttctcatctcaaggcacgtgaggtttggttcactaagtccagcacctttgggaaaaaaccaagtttggtagttcgaaggaaaccattgtcatcgaaaaaccagttttcagtttctgctgaataccgcaatggcagcaggggtggaggaagtgattttgttactggttttcttttaggaggtgctatattcggaactttgggatacgtttttgcacctcagattagaagatcccttctaaatgaagatgaatacggattccgtaaggcaaagcg

SEQ ID NO: 25881 - DNA, 357 bp, Gossypium hirsutum
  Clone ID: LIB3272-055-P1-K1-G9
ctttgttgttgttttccttgttcattattgttgcttctgcaattatcaatgggtcagcagcagtggagaaggttgggatatatgagctgaagaaaggtgatctgagtgttaaattcaccaactggggtgcaactattgtttcagtcttcctccctgacaaatatggtaaaatgggtgatattgttctgggatatgattctgtcaatgactacaagaatgatacttcgtatattggttccattgttggaagggttgctaacagaataggaggggctcaatttactttggaatggagtccattataaattgatccctaatgaaggcaaaaacatgcttcatggtggccctattggattt

SEQ ID NO: 25882 - DNA, 422 bp, Gossypium hirsutum
  Clone ID: LIB3272-055-P1-K1-H1
aaaagatcgaataaattagaatcagaagcaaaaatcgccgaggaaaacaagatgtcggggcagcaagaagaagataagaagcccggcgatcagtccgcggctcacatcaacctcaaagtcaaaggccaggacgggaatgaagttttcttcaggatcaaaagaagcacacaattgaagaagctcatgaatgcatattgcgaccgacaatctgtggatttcaactcgattgccttcttgttcgatggtcgccgcctgcgaggtgagcaaactcctgacgagcttgagatggaggatggtgatgagatcgatgctatgcttcaccaaaccggtggtactgtgtgaagcgagtactactttgccacatttagtatttgatgagttcgttatggtctgattatgtagatgtttccaatgtttttata

SEQ ID NO: 25883 - DNA, 327 bp, Gossypium hirsutum
  Clone ID: LIB3272-055-P1-K1-H10
caagtccagtgtttgtgatattcctcctcggggcctgtctatggcatctacctttgtcggcaactcaacctccattcaggagatgttcaggcgagtgagtgagcaattcactgctatgttcaggaggaaggctttcttgcactggtacactggtgaagggatggatgaaatggaattcactgaggctgagagcaacatgaatgacctagtgtatgaatatcaacaataccaggatgcaacagcggaagatgaacttggatacgaggatgaagactaggaaactgttcatggagatgaaaggtggtatgctacttgatactatgtcat

SEQ ID NO: 25884 - DNA, 248 bp, Gossypium hirsutum
  Clone ID: LIB3272-055-P1-K1-H11
atcggaaaaagtggaaaaaagcgtcgtcgttttggggtcttattattcgtcgtcttaatggctctgtctctatatgtgactctgaagctccggtacttgctttcatttactcagttttagtaaaaatccaatcacggtgacaggtaaacaacctctcatctgctataatggtacaggcatcttgaaaggcgcttgtctccataaatgataataagagacaagggatgctactatgaatgaatggcccg

SEQ ID NO: 25885 - DNA, 257 bp, Gossypium hirsutum
  Clone ID: LIB3272-055-P1-K1-H3
cttacagctaagcttcaagcaaaatatggggtttgcagtaacaactaaagctgcctggctcctgcacctatcccttttcgtactgagtagcttcacggtgtcttatcaaatcttgcctgagggtatgcctccttataaccatggaatcttgacaagagtgccaactgatcacacatcaagcctctattactagagtcaccatgaacgaccgtattcgtatccgaatccgtattcaggtccttatcacccaaccattt

SEQ ID NO: 25886 - DNA, 293 bp, Gossypium hirsutum
  Clone ID: LIB3272-055-P1-K1-H5
gaatacttaactggaggatttagaaaaagaaaaggcagttaggtgtgcgaaccgctggacctcacggcctaaagcgcagacaaactgctcatgcatgcgcaacctacaccttgggtatcacctggagacaacgggtactcggtccatcatttatggcgttccaccagtgcagatgacctatgcgggaccagtggtgagccctactgcatcatgacatcaatgcaagtgtgggtcaaatagcgctagtgatccatgctaatgccataactcgaggtcaaagccagcttttgtga

SEQ ID NO: 25887 - DNA, 325 bp, Gossypium hirsutum
  unsure (1)..(325): unsure at all n locations
  Clone ID: LIB3272-055-P1-K1-H6
atttaatttgttgtatagggtatagcaaaattcaagggagccctaaaacagggtgcttcaaagaaaaagaatccatatgtttggggctttggcgggcaattgtctccactctccactcttcactctaatccacaccagtttccaggagaatcgatttcaatcggctttctggttaaattcatctttgaaggttcttgtntgcatatatcataataagagaaaaggaatggtgctatgaattaatggcgtgtttacattctatgaatcttcgcactccttgcttatggacgagtctaccttgcattcggagacacttctcaaggaa

SEQ ID NO: 25888 - DNA, 422 bp, Gossypium hirsutum
  Clone ID: LIB3272-055-P1-K1-H7
aaaagatcgaataaattagaatcagaagcaaaaattgccgaggaaaacaagatgtcggggcagcaagaagaagataagaagcccggcgatcagtccgcggctcacatcaacctcaaagtcaaaggccaggacgggaatgaagttttcttcaggatcaaaagacgcacacaattggagaagcctcatgaatgcctattggggcccacaattctgtggatatcaaactcgattgccttcttgttcgatggtcgccgcctgcgaggtgagcaaactcctgacgagcttgagatggaggatggtgatgagatcgatgctatgcttcaccaaaccggtggtactgagtgaagcgagtactactttgccacatttagtatttgatgagttagttatggtctgattatgtagatgtttccaatgtttta

SEQ ID NO: 25889 - DNA, 398 bp, Gossypium hirsutum
  Clone ID: LIB3272-055-P1-K1-H8
aattaataaaatcttgatatagttgctctgcttttgcttctcttatactgagttccaagcaaaacccctttttgtttttcgtctgattcagctaaggtcttctttgggtagtttgagatttgagttattcatcatactatggcttctcaaccttctaagggatcagttcatgatttcactgttaaggatgcaagagggaatgatgttgatttaagtatttacaagggcaaggttttgttgattgtcaatgttgcatcacaatgtggcttgaccaattccaactacactgagctgagtaaattgtatgagcaatataaagatcaaggttttgagattcttgcattcccatgtaaccagtttggaggacaggagccagggaacaatgagcaaatcttaga

SEQ ID NO: 25890 - DNA, 343 bp, Gossypium hirsutum
  Clone ID: LIB3272-055-P1-K1-H9
ctttggtgtatctcatatcttccatttttggcttttttttcagatctcaaagatgtagacatcaaggaagaagatccacaaagataaggatgctgaaccaacagaatttgaggagtctgttgcgcaggcattctttgatttggagaataccaatcaagatctgaaaagtgaccttaaagatctctatattaattcagcagtccaaattgatgtttctgggagccggaaagctgttgttgtccatgtcccatatagattgaggaaagctttccgcaaggttcatgttaagcttgtgagggaacttgaaaagaagttcaatggccaaggatgtgaattttatttg

SEQ ID NO: 25891 - DNA, 271 bp, Gossypium hirsutum
  Clone ID: LIB3272-058-P1-K1-A1
aaaaacccaaaattaattaatgagttggcgttgcaatcacatactaacgcagcatgattcatacaataccgcttccctttatttaatgatgatggaatatagcaagagctgccgccgatcacggccgtgatcttgaatgacataagggcattgactaccctgcgctgccgcttactttgttaaacatatgactgactactactacttagtcgacccattgaagagcgttgaaaacggacgatgctatatatgtacatgcccatcctgctcc

SEQ ID NO: 25892 - DNA, 423 bp, Gossypium hirsutum
  Clone ID: LIB3272-058-P1-K1-A10
gctctctgtagccgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaagagtccttcaagaaaaacatt

SEQ ID NO: 25893 - DNA, 424 bp, Gossypium hirsutum
  Clone ID: LIB3272-058-P1-K1-A11
ctcatctacccccaaatctcctcacattatgtctttggtggccaacgaagattttcagcacattttacgtgtgctgaacaccaacgttgatgggaagcagaagattatgtttgcattgacctccatcaagggtatcggaaggcgattcgctaacatcgtttgcaagaaggctgatgtcgacatgaacaagagggctggtgaattgactgcacaggagttggacaatctcatgaccattgttgcaaaccccaggcagtttaaaatccctgactggtttttaaataggcagaaggattacaaggacgggaagtattcccaagtcgtgtctaatgctcttgacatgaagttgagggatgatttggagcgtttgaagaagatcaggaaccaccgtggtttgaggcactactggggccttcgcgtccgt

SEQ ID NO: 25894 - DNA, 425 bp, Gossypium hirsutum
  Clone ID: LIB3272-058-P1-K1-A12
gctagatccaggactaaaaagtttgctacgaaagaggcaacttttaatgcgttccaaacactttacagcctggcacagtgcacacccgacatttccagtgaggattgctacagatgcctccaggacgctattgcagacttgcaattctatttcggtggaaaacaatcaggatttgctatgtaccctagctgtactgcacagtatcagacaagccctttctatagcctaaaccaaactggattagctaagcccccggtctcgcctcaacatcctcttctactccctgcacctccacctcctcctccaggtaaaagggggatatcatcacagacagtgatcaaaattgttgtttcaacagttggctttttggttttgtcctgtttcttatgtggtgttcttggttggaaagcaaccaagaaactaac

SEQ ID NO: 25895 - DNA, 425 bp, Gossypium hirsutum
  Clone ID: LIB3272-058-P1-K1-A2
aatggagagaaaatctcaagccaaaccaattctcttcttctttgttttagtttcggcactaatcgaaacttcctacgccggtgacatcgccatctattggggccaaaatggtaacgagggtaccctgagtgatacatgtgccaccggcagatataaatacgttaacataggtttccttaacaccttcggcaatggtgccactcctggactcaacttggccggtcactgtaatccagcatccaacggttgcacctctcttagcggtgaaataaaaagttgtcaaaaccaaggaatcaaggtcatgctctcccttggaggtggcgcgggaagctactcactcgcttctcaagaagacgccaaaagcgtagctgattatctatggaacaacttcttgggcggtacctcgtcttctcgtccgttgggtg

SEQ ID NO: 25896 - DNA, 424 bp, Gossypium hirsutum
  Clone ID: LIB3272-058-P1-K1-A3
caagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgggcgcctgaccctgttacggggtattaccggccggagaactgtggggctgag

SEQ ID NO: 25897 - DNA, 420 bp, Gossypium hirsutum
  Clone ID: LIB3272-058-P1-K1-A4
tacctgtaaaagaaaaccctagccgtctcttacataccaaaactgactggagagccagtgaaccccaaagcataccctattagcacatgctcaacaaacgaccactattctggatctcgaccaacaagctgctaactacacgcagatcaaaaagggagctactgaagctactaagacacttaacagagtgtatatccgagttggttgagatggcatgccatactgagcctgttgagacactttcgcatattcctttgcttgctgaagataagaatgccccatatgtatttgatccttcaaagcaagcactagtccgagcatgcggcgtcacaagacctgtaatcgcatgctctgtcacatcaaatgaaggaggcctgctgaaatcgcaaatacaacagcttaaggatgccattgagaagc

SEQ ID NO: 25898 - DNA, 425 bp, Gossypium hirsutum
  Clone ID: LIB3272-058-P1-K1-A5
ctttcatctccttttctctttaaagaaaaattggttttcgattccattttcaatttatatattttggattagattcggttggtcttagggaaaaacaaaggaaagggcaatgtcaaccccagcaaggaagaggctgatgagagacttcaagagactacagcaagatccacctgctggtattagtggggctcctcaagataataatatcatgttttggaacgctgtcatttttgggcctgatgatactccttgggatggcggtacgttcaagctgactttgcagttcatggaggattatccaaataagcctccaaccgttcggtttgtctcacggatgtttcatccaaatatctatgcaaatgggagtatttgactcgatattctacaaaatcagtggagtcctatatatgatgttgccgctatac

SEQ ID NO: 25899 - DNA, 425 bp, Gossypium hirsutum
  Clone ID: LIB3272-058-P1-K1-A6
cccagatctcttccattctcttcttcagcgttcttttcatttccgcccatgcagcgcgctttgaaatccgcaatgagtgcccctacactgtttgggcggcagcctctcctggtggtggtcgtcgcctagacccttggcaaagttggaccatcgatgtgcctgctggcactgctatggctcgtatttggggtcgaaccaattgcaatttcgatgccagtggtaggggtcattgccagaccggcgattgtggtggactccttcaatgtcaaggttggggtgtacctccaaacaccctggctgaatatgcacttaaccaatttggaaacatggatttctacgacatttccttagttgatgggtttaacatccccatggtgtttggtccaactaatggcggttgtcacaacattcggtgcactgcagac

SEQ ID NO: 25900 - DNA, 389 bp, Gossypium hirsutum
  Clone ID: LIB3272-058-P1-K1-A7
gggaccacgcgtccgcgcctccaaatctttaaaacctttatacattccactggggcctaacaggggtcctccaaccacatggggtaaacacgtggtatgggagctgggcgcacgctgaggacccaccacaggctgcagaggtgggctgtaaaggcatacaagaagtctaacccttggaatgaaaggactgaagccatttggcgtttcttttcacatgctaaatggataggccattgaaaaagtaatgttcttacggctttaccttttcttagctgtgaaatataaagttgtcaaaagtgtaattgaccatattcggcttgatgattgatttactcggtacagcattcttcatgctatataaagaaaaccccaaaaagcgtaacttgatt

SEQ ID NO: 25901 - DNA, 416 bp, Gossypium hirsutum
  Clone ID: LIB3272-058-P1-K1-A8
gaaaaaagtcatacgcaatgagcactgccggtcaggttattcgttgcaaagctgcggtggcatgggaggccgggaagccactatctatagaagaagtggaagtggcaccaccccaaaaacatgaagtccgtattaagattctcttcactgctttatgtcacactgatgtatactactgggagtgtaagggttacactcctctgtttcctcgtatacttggtcatgaagcctcagggatcgtggagagtgtgggtgagggtgtgaatgatttgaaacctggggatcatgtgcttcctatcttcaccggagaatgcaaagaatgtcgccactgtctgtcagaagaaagcaataacatgtgcgaactgcttaggatcaactgcgaccgaggtgttatgcttgctgatgggaaaaccaga

SEQ ID NO: 25902 - DNA, 427 bp, Gossypium hirsutum
  Clone ID: LIB3272-058-P1-K1-B1
attccatttcctaaaaaatatgattcaccaagagatggatattgatcatgaatgggtcttcctccctgataatagattcctggatatcaatcaagaccatggaggaaaacgagtttctgattcaaaccttgttttcttcacagactacttcgatgaagaacagtctccgccatcagggaattcagggaaggtagctaaacaagttgtcccagttccatttccattggaaccaagaatccttaaggttccagaaaatgaaatagggaaggaaatcaccaaaagggtacctcttgatttcagttctacaccatccatgattcttgagaagatcaaagaaggtggtatggaatcagttggaggtgataaagaagtgaagacacaagtttcgtttaggaaaccaagttacaacaacaatgaatctgtcgac

SEQ ID NO: 25903 - DNA, 423 bp, Gossypium hirsutum
  Clone ID: LIB3272-058-P1-K1-B10
aaagaaatcactcctctcacaaacctcaaacaatggaagtggtgaagaacttggacatccaaagatacatgggaaagtggtacgagatagcttccttcccatctttctttcaacctaagaagggggagaacaccagcgctttttacactctgaaggaagatgggacggtgcatgtgcttaatgagacttttgttaatggcaagaaagattccatagaaggcaccgcctacaaggctgatcccaagagtgacgaagccaagctcaaagtcaaattctacgttcctcctttcttgcctatcattcctgttactggggattactgggttttatacattgatgaggattatcaatatgttcttggtggtggtcctaccaagaagtacctttggatattatgcaagcagaaacatatggatgaagaaa

SEQ ID NO: 25904 - DNA, 421 bp, Gossypium hirsutum
  Clone ID: LIB3272-058-P1-K1-B12
caaaactctctcagttcatcccatatatatacacacacaactccacttgcccatcacaaaaaatatattcttcacttcacatcttttgggcaatcaattttgtaagcaagtatggctaaggacgttgaggttggtggtgagttccaagccaaggactaccatgatcctccaccagctccattagtggacggggaggagttgacaaagtggtcattttatagggctgtaatagccgagtttattgccacgctcttatttttatacatcactgtgttgacagtgatcggatacaagagtcaggttgaccctgataagggcagtgacgaatgcggtggtgttggcattcttggcattgcttgggcttttggtgggatgatctttatccttgtttactgcactgctggtatctctggaggacaca

SEQ ID NO: 25905 - DNA, 420 bp, Gossypium hirsutum
  Clone ID: LIB3272-058-P1-K1-B2
gcctattgaaaaattttcgagtgttgatttcagtagccatcgaaaccctaattcctctttcaccatgaactgttcaatctccggtgaggtgccggaggagcccgttgtctccacgaaatccggcttgctctacgagaaacgcttaatcgagcgtcatatttcggattatgggaagtgtccagttactggggaggtacttactatggacgacattgtcccggtcaaaaccggcaagattgtgaagcccagatctttaacagcagctagcattcctgggatgcttggaatgtttcagaatgaatgggatgctttaatgctatccaattttgcattggagcagcagcttcatacagccaggcaagagttaagtcatgcactctaccagcatgatgctgcctgccgtgtgattgcaagacttaa

SEQ ID NO: 25906 - DNA, 426 bp, Gossypium hirsutum
  Clone ID: LIB3272-058-P1-K1-B3
agcttacatgtttactttctgttaaaacccagttttcttttccttatgcttcactgatcccatgaaaatttgtcctctttttgtgtcatatatatctgcaagagagtgacatcatttatatccttaacttgttcatacaatcatttgttcgaatacacatagcttaatcttgatacaaaagaatgggtctctcaagtctcccagccccatcagaaggagtgctatgtgtactcttggtaaacacagctttatccatatctatggttaaaggcataattcgatcaatccttcacgttgtcggtatccatctctcctcctcctcgtcctcctcctcctcgtcatcatcatcatcaccgtcatcctcggatcttattgaaatccctgcggtatcattcgacatcagcatcggtaatgctgatagttaca

SEQ ID NO: 25907 - DNA, 423 bp, Gossypium hirsutum
  Clone ID: LIB3272-058-P1-K1-B4
cgaaaccttaattccatcaaaataattcaaaggaaaatatctgcagaatcataatggagaattatctctttctgttctcgcttgttcttctctttggtcttttacccttttcctctcaaaccccaaaccctaaaaaccccaatcccaaacctccgctcacccaggcacacaccgagcttataaactatggttttccgatcggtcttcttccggcctcggtgacgaagtacactcttaaccaaacatccggtaacttcgccattgatctcggtggcacgtgcaagatcacgctcccgcctgacaactacctggctacttactcgaagcgggtaacgggaaagattgaaaacggaaagatagcggaactcgatgggatcagggtacgggctttgttcaaatggtggtccataaccgggattcgat

SEQ ID NO: 25908 - DNA, 398 bp, Gossypium hirsutum
  Clone ID: LIB3272-058-P1-K1-B7
aaagcattatactcgtactaagaagaaactagttgtagtaagctattatatcgtttctcctttctccctcctcgtaagaatgattagtggaatgttacgccaatggttaagtctactggtctgtgtgcttgctgttatactactcaaatctgaaggcgctagtgtagggattacttatctgcaggatgccgtagcgaaaggagctgtttgtttggatgggagtccaccagcttaccattttgacaagggctctggcgctggagttgataattggattgttcacatggagggtggaggatggtgtgaagatgtgccgacttgcctctctcgtaagaacaccgatttagggtcatcaaagcaaatggtgaagcaatttggcttctctggactcttgagcg

SEQ ID NO: 25909 - DNA, 426 bp, Gossypium hirsutum
  Clone ID: LIB3272-058-P1-K1-B8
gcacgttaaatcacgtgatggcgagtgctgacgtggaggccgtggatttcgagccggaggacgacgacctcatggacgaggacgccgccgctggtgacgcatcacctcaagtctccatgcctaagctcaagtctgccatcactggcggcgcttccgtttctctttctggccctaagaagactaaaggccgtggcttccgccaggacgacgccgaccgtcactcccatctcgcttcccgcgactttgactctctcggctctgacggcggccccggtccacagagatctattgaaggatggataattttggtcactggtgtacatgaggaagcacaagaggatgatttgcacaatacatttggtgaatttggtgagatcaagaatttgcatttaaatcttgatcgtcgcactggatttgtcaagggat

SEQ ID NO: 25910 - DNA, 424 bp, Gossypium hirsutum
  Clone ID: LIB3272-058-P1-K1-B9
gcaaagttgaaagaaaagagtgataaacatggtgcctgacaacaataggaatgaggttgaggattataagttaactgttcaagtccctgaaactgcccatcaagttagcactgattcatggctccaggccggttttgtcttgacaactggtgttaacagtgtatttgtgttgggatattctgggacaatcatggtccctcttggctggataggaggcatagtcggtttgcttttagccaccgtgctgtcgctgaacgccaacatgcttgttgccaagctccatgaacatgggggaaagaggcatatcagatacagagatcttgcagcacaaatatacggtaggagagcctatacaattacatgggcaatgcaatatatcaatctgttcatgattaacattgggtttctcattttgggtggttct

SEQ ID NO: 25911 - DNA, 427 bp, Gossypium hirsutum
  Clone ID: LIB3272-058-P1-K1-C1
gcagccatggcagtccgtatgcttcttgggttaggtgtcctgctactctgccttgcaaaggtttcatctgatctgaaggcagaagaagttataaccaatgtcggtgaggtgggttctttggttaccagaggcggaaacagaagactgatgctagagattgattgtggaggattatgcaagaaaagatgcagtcaacactcgaggccaaacagatgcaacagggcgtgtgggacttgctgcttgaggtgcaagtgcgtgccaccggggacttcagggaacagggaggtctgcgggacctgctatactggcatgaccacccatggaaacgttgccaagtgcccttaacctttacgtcgcccaatatgtgttgcagccatcaaggggaaaaatgaaatgtttggttgtgtaatatgtatgttgtagctca

SEQ ID NO: 25912 - DNA, 424 bp, Gossypium hirsutum
  Clone ID: LIB3272-058-P1-K1-C11
gtcacacccgaaagcgcaaaaaaaaaaaaaaaaaggaaaagaggaaaaacgttctctcccacgaaacccaccattactgcaaatggcgacgacggcccccgacaacctgagccgcgatcagtacgtttacttagcgaagctatccgagcaagctgagcgctatgaggagatggttcagttcatgcaaaaactggtcctcggctcaaccccagccgctgaattaactgtcgaggaaaggaaccttctctccgtcgcctacaaaaacgtcatcggatctctacgtgccgcgtggagaatcgtttcttccatcgagcagaaagaagaaggtcgaaagaacgaggaacatgttgtgctggttaaggagtacaaatccaagattgaatccgaattgtcggaagtttgcgctagtatcttgactttattg

SEQ ID NO: 25913 - DNA, 206 bp, Gossypium hirsutum
  Clone ID: LIB3272-058-P1-K1-C2
ggccccagccatagacacaggcacagccacagccacagccgtagaagatctttataacatcggcgtagcatctgaggatcgctcaaaagctcttctatgtacgcctaatcgtatgtggaaaggtggtgttagtgtataatgcatacagaccataccacagatattaatgatagataccacgcgaatattacaacggacggcactgg

SEQ ID NO: 25914 - DNA, 424 bp, Gossypium hirsutum
  Clone ID: LIB3272-058-P1-K1-C3
ctcatcttccgttgtttatacgtttggttgttgttgaagaagtgctactaccatggctacaaagaagagcgttggggacttgaaggaagctgatttgaagggaaagaaagtgtttgttagagtcgatctgaacgttccattggatgataacttcaacataactgatgacacaaggatccgtgccgctgttcccaccatcaagtatttgatgggtcatggctctaaagtcatcctctctagtcatttgggacgcccaaagggtgtcactcccaagtacagtttgaagcctcttgtgccaaggttatctgaactccttggagtcgaggttaaaatggcaaatgactgtattggtgaagaagttgagaaaatggtggctgcattaccagatggcggtgtattgctgcttgagaatgtgaggttctac

SEQ ID NO: 25915 - DNA, 375 bp, Gossypium hirsutum
  Clone ID: LIB3272-058-P1-K1-C4
aagattttatagcctgttgctgtgccagctattgcttttagatgccaagaagatgagtaggtgactattgggtgagggagaagactaacattggcattgaggtgatggagcacgtggggtctactaaataaccaagtattgtccatcggatcaacatgctcgacggtctagacaggtgggagcatgtaaggatgaagaaagagaatgctgatatgaacacgaagctgtatacgactcctttgtagcgtgagatgctcaaagctgacccggagcgaataatcactagtgttattgatttgagcggactggggagcacggattgcttgcgcactgagggtgacgcccctagacgccgggtgtttgtgaagggtttga

SEQ ID NO: 25916 - DNA, 425 bp, Gossypium hirsutum
  Clone ID: LIB3272-058-P1-K1-C5
cggacgcgtgggtttttaactctaaagccaagaaagcaagccactaaggttttgagagaagatcaaaatggcttctaaaagatcagcttccatggtcctccttttggcactcaacattctctttttttccctagtcagtgcttgtggctcttgctcttcacccacccctaaaccaaggccaaacccaaaccccaacacccccactcctactccatctgcacgaggcaggtgccctagggatgccctcaaattaggtgtatgtgccaatgtgcttaacctagtcaatgtcaccgttggttcacccccagtgatgccatgctgttcccttctcaatggccttgtcgacctcgaagctgctgcatgcctttgcaccgctatcagagcaaacattttaggcatcaacctcaacatcccaatttccctta

SEQ ID NO: 25917 - DNA, 349 bp, Gossypium hirsutum
  Clone ID: LIB3272-058-P1-K1-C7
gaaaaacatgggttttgaaaggcgggaggttatatggttatcagggcttgtgttttgaatatccttgtcttatccacagctgatgtccattattacgagtttttttgcaagaatcccagttcactaagctgtgtagcacgaagagcatcttgaccgtcaatggcagctttccagggcctgagattcgggttcgcagaggggacacagtttttgtcaacgtccacaatcaaggaaaccatgctgtatccctcaagtgggagggcgttaagggttcaattgatggttcgaatgagttaattcagccagggagaaacttcacttacaagatagagttaaaggatgaaatagg

SEQ ID NO: 25918 - DNA, 229 bp, Gossypium hirsutum
  Clone ID: LIB3272-058-P1-K1-C8
gcggcggctgacggcaacgttagggagtccggagacgtcggcgggggcctcgggaagagttatcttttctgtttaacggcctgcccaccctggaaacggctcagccggaggtagggtccagcggttggaagagcaccgaacgtcgggttgtgtccggtgcgcccccggttgccatggaatatacttaggaccgattgccgtcacaccccttttgttctcataacacaat

SEQ ID NO: 25919 - DNA, 421 bp, Gossypium hirsutum
  Clone ID: LIB3272-058-P1-K1-C9
tttttcttttgctcgatctgaatctggttaaaataacagaagaacaatggaagagctgaaatcagctgtggaggagcacatggaattaatggcggatctagttcagaagctatcctcggagcttcgttcgggcctccgacccgcctatgataactttatgggcttcttccatgcaatcgactggaaggagccatggttaatgtgcttactggcattccatgttttcttattgatagtaacaatcttctcgaggaagaatactaacttccagatgtgtttgttccttctggcattgctcggtgtttattttgcggagttactgaatggattccttggtgacaactggaagaaatttgcaaaccagaactattttgatccaagtggactttttttgtcagtactctggtctggtcctcttctc

SEQ ID NO: 25920 - DNA, 425 bp, Gossypium hirsutum
  Clone ID: LIB3272-058-P1-K1-D1
ggaaccgatggttccgtttaattatacagggattgcaccgaataatacgaatgtgatgaatgggactcgtacggtggtgttgccgtttaatacgagtgtggagctagtgatgcaggataccagcattcttggtgctgagagtcatccattgcatcttcatggtttcaatttctttgttgttggacaagggtttgggaactttgatccggttaaggatccggcgaagttcaatcttgttgacccgatggaacggaatacggccggtgtgcctgccggtggttggatagccattcggttcttagcagacaacccaggggtgtggttcatgcactgtcacttagatgttcatacaagctggggactgaaaatggcatggatagtgttggatggtccggaaccgaatcagaagctgcaaccaccaccgt

SEQ ID NO: 25921 - DNA, 418 bp, Gossypium hirsutum
  Clone ID: LIB3272-058-P1-K1-D10
cgacaattccacgctcttggccaatcccgccctcacggggaataaatataaatatcttcctctggcgcttgctattctttccaaaggcattatggatgtgagacttgggctcttattcctctttgtattgggtgcaagctgggtttgcgatgctagacaactagaagccgctccggtagtactctctggtgcatcagttgtgcagacaaaccaggggcaagatgaggaagtagtagaaaacattgtttggaaggacaatgtgtgcacattgtgtgaggaatttgctactgaggcaattaatttcctttcacaaaacaagacccagactgagatagttgaggtgcttcacaagagttgctctcgtattccttcttttgagcagcagtgcatcacactggtggactactatgttcctctc

SEQ ID NO: 25922 - DNA, 424 bp, Gossypium hirsutum
  Clone ID: LIB3272-058-P1-K1-D11
ctcactgttttccttcaaaaccctaatagctgtcctcgcctcctgaacgtgttcgaaaatggccggttctgagggattgactctacgtggcaccatgcgtgcccacaccgacatggtgacagccattgctactcccatcgataactccgacatgatcgtcacttcctcccgcgacaaatccatcatcctttggcacttaaccaaggacgaaaagacctacggtgtccctcgtcgtcgtctcaccggtcactctcacttcgtccaagacgttgtcctctcttccgattctcagttcgctctctctggttcctgggatggtgagcttcgtctctgggacttatctgccggtatctcagctcgccgttttgtcggccacaccaaagatgttctctccgttgccttttcaattgacaaccgtcaaatt

SEQ ID NO: 25923 - DNA, 420 bp, Gossypium hirsutum
  Clone ID: LIB3272-058-P1-K1-D12
gcagcctcatatgtcagtgtgttccgatgtgaaattggcattgcaggggataaataagatattggagaccacgggagctaagctgaatcttgattattcggaatggaggcaggagttaaacgagcagaagctgaaattccctttgagttacaagacctttggtgaagctattccacctcaatatgcaattcaggttcttgatgaattaactggcgggaatgcaattataagtaccggtgttggccagcatcaaatgtgggctgctcaattttacaagtataagaagcctcgtcaatggttaacgtctgggggattgggtgctatgggatttggattgcctgctgctattggagctgcttgtgcaaacccggaggcagttgttgtagacatcgacggtgatggaagttttatcatgaatgt

SEQ ID NO: 25924 - DNA, 426 bp, Gossypium hirsutum
  Clone ID: LIB3272-058-P1-K1-D2
cacgcatattgaaaaagcaaataaaaaaataaaagaggttgctattctatttttttctttaattttgattgcaaactaaaacggtgcggtgtagagggggggaagactcgcgcgcaagcccaatccataggctggatccgcgccttggtgtttcggatggtaaattttcgtgtcaagtccttcgtctttgcgcaaacttttcgttgatccttatttatattttattttgtttcaatttttctctatagtttgcgtgactttgcaattaggtatgcacttaggcgtcatgtttgggatctggattattttcagttttgatccctgagcgttcgcgcgtactgtgattcagttattatttcaatagtttatttatttattaattaatttttttaagtttgattttacttcaattaagtttttctatca

SEQ ID NO: 25925 - DNA, 429 bp, Gossypium hirsutum
  Clone ID: LIB3272-058-P1-K1-D3
aaaaaatatcttgaaacccggagatgtcggacgaggagcaccatttcgaatccaaggccgacgccggcgcctctaaaacctatcctcagcaggccggtactatccgcaagaacggctatatcgtcataaaaaaccgcccatgcaaggttgttgaagtttccacctccaagactgggaagcatggtcatgctaagtgtcactttgtcggaatcgacatcttcactggcaagaaactggaagatattgttccatcttcccacaactgtgatgttccacatgtcaatcgtactgattaccagttgattgacatttctgaggacggatttgtgagtttgctgactgacagtggagacaccaaagatgatttgaggcttccaactgatgacaacttgttgaaacagataaaggacggttttgctgaggggaaag

SEQ ID NO: 25926 - DNA, 423 bp, Gossypium hirsutum
  Clone ID: LIB3272-058-P1-K1-D4
ctactttatatctctcttctctgcttttacaagcaaatttcttcgaggctgtattttcagatatcggaactggcaaacagcaattccacggacaaatggattataaagcggctggtttatatacgttggatgaagcccttgaaactgtggggtttgggaaattccagggctttgttcttggatacgctggtcttggttggtttgctgaagccatggagattatgattctttcctttataggacaagctgttaaatctgagtggcaactttcctctggtcaggagagccttttaagtaccatcgtctttgctgggatgcttctcggagccaatacatggggccttttatcagataactacgggaggaggaaaggttttcttactatatctatggtaacttttggagctggattactgagcacat

SEQ ID NO: 25927 - DNA, 427 bp, Gossypium hirsutum
  Clone ID: LIB3272-058-P1-K1-D5
gtaccaaaaaaagataccttgttttatttgatcttcaagtcctgaggatgaggatgagtcgaggttacaacaggttagccagctccatgtttacaatggtcagccctcgattcttttccacagcagcaacacggggggtcctctccaacgacatggtgaaggctcccgccgttggacttggcgtgcgctgcaggagctctatggcggcgatagctggtggtgacaaggagcaggagaagaaacaagcagtaggcggcggcggcggctcctccaaggatgacaaagagatcgtcagttattggggcttggatccaactaaggtgtccaaagaggacggctccccatggaagtggacctgctttaggccatgggatacgtaccaggcagacttgtcaatagatctgaagagacattacgcaccggtgac

SEQ ID NO: 25928 - DNA, 425 bp, Gossypium hirsutum
  Clone ID: LIB3272-058-P1-K1-D6
agaaaacgcacttctggaactatcgaagaagagagaattatttcaagatttggctccattgttgtggaattcttttggtactattgctgcacttttacaggagatagtttcaatttatcctgttctctcacctccaaatctgactccagctcaatcaaatcgagtttgtaatgctcttgctctgcttcagtgtgtagcttctcatccagacacaaggatgttattcctgaatgctcatatacccttgtatctgtatcctttccttaatacgaccagtaagtcaaggccgtttgagtatttgaggcttactagcttaggtgtcattggtgccttggtgaaggttgatgatactgaagttatcagcttcctcctgtccactgagataatcccattatgtctgcgcacaatggagatgggcagtgaac

SEQ ID NO: 25929 - DNA, 422 bp, Gossypium hirsutum
  unsure (1)..(422): unsure at all n locations
  Clone ID: LIB3272-058-P1-K1-D7
gggaagctgaaaatcaactaatagccaaaagaaatcggacccaacattgaataaggatgaacagtagtgaagggaagttgaaatcatcgagttccgaattggatttggatcgacccaacatcgaagattatctcccttctggatcttccattcaagaaccacatggcaagcttcgcctgcgggatttgcttgatatttctcccgctttaactgaagctgctggtgctattgttgatgattcattcacacggtgttttaagtcgaatcccccggaaccgtggaactggaatgtgtatctgtttcctctctggtgttgtggtgtggtatttcggtacttgattttgttccctatgagggctttagttttgacaataggatggataatatttctgtcatgcttcattcctgtgcactntcttctc

SEQ ID NO: 25930 - DNA, 420 bp, Gossypium hirsutum
  Clone ID: LIB3272-058-P1-K1-D8
ctttttatctttaaaacacgcacccaaaaaataaaacccttcgaaaaccaaagaaggaagaagaagatgtcgtggcaagcttacgtagatgatcacttgatgtgtgaaatccaaggaaaccatctctctgccgccgctatcatcgcccacgacggcagcgtttgggcccaaagcgccaatttccctcagttcaagcccgaagaaattaatgccatcatgaatgactttaatgaaccgggtacgctcgctcccaccgggttgcacctcggtggcacgaaatacatggtgatccaaggcgaaccgggagctgttatccgagggaagaagggacccggaggtgttactgttaagaagaccaatatggccttgatcatcggaatctatgatgaaccaatgacacctcgccaatgcaacatgatc

SEQ ID NO: 25931 - DNA, 410 bp, Gossypium hirsutum
  Clone ID: LIB3272-058-P1-K1-D9
aaaaaacttaaaattctctgcaggagaggaagtgaagaaccctccaagctccggcctacggccttcatcgcccacgcgccatacgcaccaccgcccacggcggttggaaggtgaaaagcctccaatttttcaggcgaaacacaggtgacgacaagagaatgggcaacaatcgtacgttgatgatgcgaatctgccggtggtgggattggcacaccgattgcggcgtgaatttaagatcctttgtctgacgcttgcggtgcccagggtttctgaaaccctaagccttctgtcttctgttaatgatttgggcccccttgggccgtgtttaggcgttgcgttgggtgtaaccgggtatttgtgttttaaactaattgggctatgtacatgggctactgtaaaaggacttttat

SEQ ID NO: 25932 - DNA, 426 bp, Gossypium hirsutum
  Clone ID: LIB3272-058-P1-K1-E1
ctgccgcatctcagtacctccgcagttcactgagaaatggatgaggaagttaaggctgtggttcctgagtcactcttgaagaaacagaagagggctgaagaatgggagcttgccaaaaagcaggagcttgaagttgcaaagaagaagaaagtcgagaaccgcaagctgatttacactagggctaagcagtatgcaaaggagtacgaggctcaggaaaaagagctgattcaattgaagcgggaggcaaagttgaaaggaggattctatgtagatccagaagctaaactcttgttcatcatccgaatccgtggtatcaatgccatgcacccgagaacaagaaagatcttgcagctattgcgtttgagacagattttcaatggtgtttttcttaaagtgaacaaggcaacaatgaacatgcttcacctg

SEQ ID NO: 25933 - DNA, 421 bp, Gossypium hirsutum
  Clone ID: LIB3272-058-P1-K1-E10
gaaaaaaaagagcttccgccacatggaaaggaactccgcggcttccgttccgtatttactcggccactcccttacaaaatagaaacagaacccttcattacctcaaatattcgtctccctattactcttttcctctagggttagggttttctttcccgattcacctccgttctctttcttctgataagctatggaatctaatctcgttatcaaggttaagtatggaaatactctaaggcgtttcaatgctcgaattgttgatggtgaacacctggatcttaatatgactggactaagggcaaaaattatggggcttttcaattttccttttgatagtgaacttactctgacatatattgatgaagatggggatattgttacccttgttgatgatgatgatttgtgtgatgtgatgaggcaa

SEQ ID NO: 25934 - DNA, 421 bp, Gossypium hirsutum
  Clone ID: LIB3272-058-P1-K1-E11
cgctcactgggtctctctgtactgtcttctccataacattcgtctctcagatcctttcctcttagatcatcaaatccattcctttttttcaccaaaacatgagggaaatcataagcattcatataggtcaagctggtattcaagtcggtaactcatgttgggagctttactgccttgaacatgaaatccaacccgatggaatgatgcccagtgacacctctgtaggtgtagcaaatgatgctttcaacactttctttagtgaaactggttcagggaaacatgttcctagagctgtgtttgtggatctggaacctactgtgatcgatgaagttaggactgggacttaccgacaacttttccaccctgaacagcttatttctggcaaagaagatgctgccaataactttgccagaggccatta

SEQ ID NO: 25935 - DNA, 422 bp, Gossypium hirsutum
  Clone ID: LIB3272-058-P1-K1-E12
ttttgtttcagcccaaatcatctttctattagcctgttcctcatggaatcccatattgagaaaaaaaaaagatgcgcttcaaaaatctttcaaagaaatgatatctactctccctaaagggaattgttggggttgttttgaagatctatgtcaatatcaaggtttttggttcttctcgacttttctacaaggagctttgtcggctcaacaacaattccaggcgcaacccactgatatcatcctttgtagctctccaagaacaggcacagcctggttaaaatccctcactttcgccactattacaagaaccttatacgatgattccaccacccctttgctttccaagatgcctcatgatgttgtgcctttcatggagttcgatcatgcccagttttccactaatcgacatcttggaattcctc

SEQ ID NO: 25936 - DNA, 425 bp, Gossypium hirsutum
  Clone ID: LIB3272-058-P1-K1-E2
gtttcttcaatggaattttggtgcatccttaacctcagagccactcttattactcttcttcttattctcttttttcatctttccaagaaactttactctaaattctttcctcctccttccgttcttcatcttccttctccttcttcatccacttcccttcctgaatctcaatcaagaatcccagagattgtatctgattcagacttgaagtttttgattgataatctggatgagaagctcgatgaggacgagaaatgggagactgtaattgataagaaaaccaactctttatcctacaaggcaaaatgctgcagacctaagaataaaccactaaaatacctgagcacgactgtatttgagggttgctctccggagcttctgagggacttctatatggacaataattatagaaagcagtgggataa

SEQ ID NO: 25937 - DNA, 423 bp, Gossypium hirsutum
  Clone ID: LIB3272-058-P1-K1-E3
gctctctttcattaacttaagaattttaaaagaaaaaaagtatcgtattgttgattaaacctgcttggttaatcccagattcagcttgggataatacgaattgcaattgctgaattgttgttggctagaaagggtgaaagaggcagagaagaaatcagacatgttgcagtgtatatttcttctatctgattctggagaggtgatgctagagaaacagctaactgggcatcgcgttgacagatcaatatgtgattggttttgggatcatgttatttctcaaggcgattccttcaagtcacagccagtgattgcttcacctactcattatcttttccaagtagttcgagaggggattacatttttagcttgcacccaagttgaaatgcctcctttaatgggcatcgagttcctctgcagagtttc

SEQ ID NO: 25938 - DNA, 426 bp, Gossypium hirsutum
  Clone ID: LIB3272-058-P1-K1-E4
aagaaaagaaaaattacagtgaaaatgtcaacccttaaagttccagctcatgtacctgccccttctgaggatgctgagcaacttcgtaaagcttttgaaggatggggtacaaatgagcaattgattatcgacattttggctcacaggaatgcagctcagcgcaatttgattcgtaaaacttatcgtgaagcttatggggaagatctccttaagtctttggatgaggaactttcaagtgactttgagcgagctgtggtgctgtttactttggaccctgcagagcgtgatgcatttctggctcatgaagctacaaagaggttcacatcaagccattgggttctcatggaaattgcttgcactaggtcttcacatgaactgttcaatgtgaggaaggcgtatcacgatctttacaagaaatcccttgaa

SEQ ID NO: 25939 - DNA, 429 bp, Gossypium hirsutum
  Clone ID: LIB3272-058-P1-K1-E5
ggaagaagcaatggcgagaatcaaggtccatgagttgagacagaaatcaaaaactgagcttttggctcagttgaaagatctcaaagctgagctcgctcttcttcgtgttgccaaagttaccggtggtgcacctaacaagctttccaagataaaggtggtgaggttgtcaattgctcaggtgttgacagtgatctcacagaagcagaaggctgcactgagggaggcatataagaagaagaagttcttgccccttgatctccgtccaaagaagaccagagccatcaggagaaggcttaccaagcatcaggcatcgctgaagacagaacgtgaaaagaagaaggaaatgtacttccccatgaggaagtatgccattaaggtgtaggataagatatttgagattctattttgaaatccgtttgtgtttactta

SEQ ID NO: 25940 - DNA, 427 bp, Gossypium hirsutum
  Clone ID: LIB3272-058-P1-K1-E6
attttcattgggcacactctttcaaactaacccaaacgcggccgccgggttttgttttcagaatcagcagcagcttgtatttagaaggatggtgagggtcagcgttttgaacgatgcactgaagagcatgtacaatgcagaaaagaggggcaaacggcaggtcatgatcaggccatcctcaaaagtgatcatcaagttccttttggtcatgcagaagcacggttacattggagagtttgagtacgttgatgatcacagatctggtaaaattgtagttgaactgaacggaaggctgaacaagtgcggggtgatcagtcctcgcttcgacgtaagagtgaaggagatcgagggttggactgccaggctgcttccatcaagacagtttgggtacatagtgctgacaacatcagctggaataatggaccat

SEQ ID NO: 25941 - DNA, 422 bp, Gossypium hirsutum
  Clone ID: LIB3272-058-P1-K1-E7
ctcaatcatccatttattcttttctttcaactcaaagtcccaagtagtattagaatcatgggtgttgtcacttataactatgactctacctcccctgtcgctcccgccaggcttttcaaggccttcgttcttgaagctgacaaggtctggcccatagctgcccctcatgcaatcaagagtattgaggttgaagctaatcctggccctggatgtatcgtaaagatcaactttgttgaaggccttccattccaatatatgaagcaccagattggaggacatgatgaaaacaaattttcatacagttacaatttgattgaaggtgggcctttggggaacaagcttgagaaaatcaactacgagaataagtttgaggcagctgtaggtggaggaagtgtttgcaagagctcgatgaaattttacac

SEQ ID NO: 25942 - DNA, 427 bp, Gossypium hirsutum
  unsure (1)..(427): unsure at all n locations
  Clone ID: LIB3272-058-P1-K1-E8
aaataaacagtaaaaaagcaatctgctgctctgtttgggtttttttcgacaaaaaatcccaacaaaaccgctgccgttgttcaccttctccaaagcattgccggtgaattgctgattatcttacccaccccataaaataaaagaaggaaaggaagaacaaaaaaatgtatggaatcacaggttacagtaatggctaccaccaaaatcaacagcagcacagttcggaagagaagcgaggcggaggtcgacggaggaggggaggccgtagatcacgccaccgtcccggctttagggtttccgaccaccatcaccatcactacaataacgatgacgacgatgacaagcaagagcagaaagcacctncgccttgcacggacttcgacatggcctactttcactcttatgctcacgttggtatccatgaaga

SEQ ID NO: 25943 - DNA, 336 bp, Gossypium hirsutum
  Clone ID: LIB3272-058-P1-K1-E9
ttttatttttggctgaaaaaaacaatgaattgaaaggtgtctcagctgttcctctttacacttgagctgaggggaaacacatatttactactatatatataaaactcccaccacaagggggggaaaaacccatatattttaagccatgaaacagttacacaagcaatcaatctttaaccataggcgagatgaagagattttaatacctcacacactttcttactcacccaattcctaaaaacaccccagatctttccctagatccattttctttaaagaacaacgccttttggttttttttatgggcattttaaatgggtatactttttttatcct

SEQ ID NO: 25944 - DNA, 409 bp, Gossypium hirsutum
  Clone ID: LIB3272-058-P1-K1-F1
aatgacttcccaattcccagtcccacagaatcagagtaattcatttccaagcgataagttttagggttttgagttctattctcttgacaatggctgcgatttacagtctttacataatcaacaaatcaggaggtttgatattttataaggattatggatccaaggggcgcatggatacgaatgatagcttgagagtggctagtctatggcattcgatgcacgctatctcacagcagctatcgcctaccactggttgttctggaattgagctacttgaagctgatacatttgatctccattgttttcaatctcttaccgggacaaagttctttgtagtttgcgaacctgggacacagcacatggaggctctcttgaaagttgtttatgagctctacacagattatgtttt

SEQ ID NO: 25945 - DNA, 343 bp, Gossypium hirsutum
  Clone ID: LIB3272-058-P1-K1-F10
tcgaacgtggtgtggtgtccggtgcgcccccggcggaccttgaaaatccggaggaccgtgtgcctgtcgcgcccggtcgtactcataaccgcatcaggtctgcaaggtgaacagcctatggtcaatggaacaatgtaggcaagggaagtcggcaaaatggatccgtaacctatggaaaaggattggctctgagggctgggcacgggggttccagttccgaacccgtcagctgacggcgcactgttcgagctgctcccgcggcgagagcggatcgccgtgtgccggccgtgggactgactgtgaacggctccctcgggggccttccccgggcgacgaacagtcg

SEQ ID NO: 25946 - DNA, 423 bp, Gossypium hirsutum
  Clone ID: LIB3272-058-P1-K1-F11
atttaaagctgccgctgatttctctcgtggggggtttttttttttttctcttttttaattttcttaagtagccataggatgaggaagctagagtttcatgagaaaaaactgttgaagaaagtaaattttttggaatggaaaagagaaggtggtcaccgggagaatctcattctgcatcgttatcatgtcactggtcgtgacgattataagaaatattccggtttgtgccggatggtccagaaattggtgaatatattgaagcagatggatcctcgagacccttttcgaatcgagatgactgatttgctgttagagaaactatacaatatgggcgtaatcccaaccaggaaaagcttggctctatgtgatcggttatcagtgtcatctttttgtaggcgtaggctctcaaccgtgctggtgcac

SEQ ID NO: 25947 - DNA, 421 bp, Gossypium hirsutum
  Clone ID: LIB3272-058-P1-K1-F12
tccgtctaaggaagagaatccaaaagcaaaggcaatagaaaatggcagaaaacgaagacattcagcctcttgtttgtgacaatgggactggaatggtcaaggctggatttgctggagatgatgctccaagagctgtattccctagcattgttggtcgcccacgtcacacaggtgtgatggtcggtatgggccaaaaggatgcttacgtgggagatgaagctcaatcgaaaagaggtattttgactttaaagtacccaattgagcatggtattgttagcaattgggatgacatggagaaaatctggcatcataccttctacaatgagcttcgagttgcccccgaagaacatccggttctcctcacagaagctcctcttaacccaaaagccaatcgtgaaaaaatgactcaaattatgtttga

SEQ ID NO: 25948 - DNA, 415 bp, Gossypium hirsutum
  Clone ID: LIB3272-058-P1-K1-F2
cacattatttctactgaatgctttatctaaacatgggccggtctgtgggggtggcttatccatacccctgtcagggcctgcgttagtttaaagcagcgatgggtgaaggaaagggctcaaccctagagcaccttctggaggtagtccttagctagggcgcatttgggtttgccattgcagccgagagacgaagaagcgatggctctgttgttaaagatgacataacatattctacatatggtgtgctacaacatcggatgttgccactggctatggaggaggtgctttcttgcatcttctgtttagcgaatcactggtgatgggaggtacacattgcatgtgttaggggaggccattagcactcgggtagtgatcgagcttggactatgatatattatggctgaaactggctgac

SEQ ID NO: 25949 - DNA, 424 bp, Gossypium hirsutum
  Clone ID: LIB3272-058-P1-K1-F3
cccaaatctccaattctgtttcatttttcagcaaagctagaaagacaatgactaaggatattgagactgcagagcaacgtggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcaccgctggtatctctggagggcatatcaacccggctgtgacattcggtttgtttgtgggacgcaaggtgtcact

SEQ ID NO: 25950 - DNA, 423 bp, Gossypium hirsutum
  Clone ID: LIB3272-058-P1-K1-F5
cgcccatcgtctgcttttgccaaaagacacctaaagacgccactttgaaaaccggaaatgtcggacgaggagcatcatttcgagtccaaggccgacgccggcgcttccaaaacctaccctcagcaggccggcaccatccgcaagaacggttacatcgtcatcaaaaatcgcccctgcaaggttgttgaagtttccacctccaagaccgggaagcatggtcatgcaaagtgtcactttgttggaatcgatatcttcactgccaagaagctcgaagatattgttccttcttcccacaattgtgatgttccgcatgtcaatcgtactgactaccagttgattgacatttctgaggatggatttgtgagtttgctgactgatagtggagacactaaggatgatctgaggctcccaactgatgagaac

SEQ ID NO: 25951 - DNA, 334 bp, Gossypium hirsutum
  Clone ID: LIB3272-058-P1-K1-F7
ggatttcactatcactcttgacggcagcaaggctttaaatgaagggggtggggttgtctccttgccgagagaagcttacctatactgtaaatccgagatctgcagcgccaatgtaagtaccttaattagtattattcaacttagattgaaggaggggacagaatcccagcggggctcttaagaatctttcgttgtcaggactaataacgcaagaatcgtatggtacttaagaaagacattggtgcagagaaagaagtacggcaacctggcttgttatatatggttatttgatgccatttgttgtggcagaagggtatcagattttaactggctg

SEQ ID NO: 25952 - DNA, 425 bp, Gossypium hirsutum
  Clone ID: LIB3272-058-P1-K1-F8
gccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaagagtccttcaagaaaaacattgagggagcaaccaag

SEQ ID NO: 25953 - DNA, 425 bp, Gossypium hirsutum
  Clone ID: LIB3272-058-P1-K1-F9
caaagatatcactgcaagaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgc

SEQ ID NO: 25954 - DNA, 313 bp, Gossypium hirsutum
  Clone ID: LIB3272-058-P1-K1-G1
ctattagcaagaccaagactttcattgcggtggctgtaccaagtaggaatgggaagcaggagaaggaggaggcaggggagcttgggattccattggagtctaaacagactcaagagcagccgcaggcttagtgttaagcccttcgcgtgggctccttttgttgttggtaaatttgtgatcttttgcaagggatttcactgtttcaaaaactgcttttccttaatgtaataattgtcgtttttcaagggtctggattgttttttgagtttgtcatgacattcattctctgctctatttttgattggtttatttg

SEQ ID NO: 25955 - DNA, 416 bp, Gossypium hirsutum
  Clone ID: LIB3272-058-P1-K1-G10
ctcactgttttccttcaaaaccctaatagctgtcctcgcctcctgaacgtgttcgaaaatggccggttctgagggattgactctacgtggcaccatgcgtgcccacaccgacatggtgacagccattgctactcccatcgataactccgacatgatcgtcacttcctcccgcgacaaatccatcatcctttggcacttaaccaaggacgaaaagacctacggtgtccctcgtcgtcgtctcaccggtcactctcacttcgtccaagacgttgtcctctcttccgattctcagttcgctctctctggttcctgggatggtgagcttcgtctctgggacttatctgccggtatctcagctcgccgttttgtcggccacaccaaagatgttctctccgttgccttttcaattgacaacc

SEQ ID NO: 25956 - DNA, 410 bp, Gossypium hirsutum
  Clone ID: LIB3272-058-P1-K1-G12
ggaaacctgtaattttgcctcaagcatttgcgcaatccaagccaactgcagacagcggttacttccgtctcaacaccatttgatctttcaggacttggagttccggaagatgggcagaaaatgatcagcgaactcatgtcggtttacgataacaacattcaaggcagcaaaaacatgaatcccagtaacaatccaatcgccgaaggccaaaatattcttcacccgaaaatccaacagccacaggatgaatactttcgtggtcaaggaaacttcttcgaggactccagcatgcccaataaccatcagatgtttccacaaggggaaggtcaatttgaccggttcaagggcctgaattctctgtttgagaccgaacataacaacaacaacagctttccggtgatggtcgggtt

SEQ ID NO: 25957 - DNA, 429 bp, Gossypium hirsutum
  unsure (1)..(429): unsure at all n locations
  Clone ID: LIB3272-058-P1-K1-G2
cagactctggctaggttgggaattaggacccatcatcaaccctgcgctgcttgtaggatgctacgcaggcgatgcgacagtaactgcatcctcgccccatatttcccaggcgatgagcctgacaaatttgccggtgtgcataaggtttttggtgctagcaacgttatcaaactgattcagatggtggaggaaacaaacagggaggatgctgttaaagcgctggtgtatgaagcgagagcaaggctccgagaccctgtttatggcagcacgggaaccatttttcagctgcagaggatggtgcaagacctaaaactgcagcttaaatcaacaaatgctcgagtattggaattgcagcagcaaaaagatcagttgctgggcatctttatgaattttgatcatcttgatgtactctcttnncgtgatcatggg

SEQ ID NO: 25958 - DNA, 429 bp, Gossypium hirsutum
  Clone ID: LIB3272-058-P1-K1-G3
gcgaccctctttttcctctaccaggtgattttagctttgtgttagttcctttaagcaatccgccaagatgcagaacgaagagggtcaaaacatggatctttacatccccaggaagtgttccgccactaacaggctcatcacctctaaggatcatgcttccgtccaaatcaacgtgggacacttggatgagcttggcagatacactggcacattctccacttttgctctttgtggatttgtccgtgcccagggtgatgctgacagtgctcttgacaggctttggcagaagaagaaagctgaagtccgacagcagtagttggatacctttttaccctagtctatctccgagcttgggaaagaaaaatctcatggcagcgactattatgttctaggttttttcaggttaaactatgtcaaatttatattttt

SEQ ID NO: 25959 - DNA, 416 bp, Gossypium hirsutum
  Clone ID: LIB3272-058-P1-K1-G4
caaggttcgaaaggcaagccaaagtccatatataaaaagtaaacacagatttgcagaaatgttgaagcaagtttctttgatttgctttcttattttctcttgttatatgggagttgagtccaaagatttgaagcatcttaccaatgaacttgaagtaaatgtggcagcaagtagggtttgggagctttataggcaccttgggatttccatgcttactgctcgagagctcaaaactgtgatccaaagtgttcaagttttgaaaggtgatggtggtgttggaactatcctcaaactcacttttgttccaggcaactcaagctatactgaaagattcattaagattgatgatgaaaagaaggtgaaagtggcaaagggattggaaggagggtgtcttgcaattggttgctcggatcaaa

SEQ ID NO: 25960 - DNA, 422 bp, Gossypium hirsutum
  Clone ID: LIB3272-058-P1-K1-G5
gaaaactctgagagaaatggcttcttcaattatatctttgcaaaccagcaatttgaggtctgcatttttgggagagaaaaatgggagctgtgtttctagcattcccataactcgcgtaagtttagtgaggaaggctattgagtgtaaggagtcgagaatcgggaagcagccaataacggttccgtccaatgtgacgattactatggagggtcaggacataaaagtaaaaggtcctttgggagaaatggcattgacatatccacgagaagtaaaggttgatagggaggaatccggagccctaaggatcagaaagtcagtggagactaggagagccaaccaaatgcatggccttttcaggactcttactgacaatatggtggtgggagtatcaaagggttttgagaagagacttcaactaattg

SEQ ID NO: 25961 - DNA, 380 bp, Gossypium hirsutum
  Clone ID: LIB3272-058-P1-K1-G6
cccacatcccccaattatatattttatcccaacaaacatcttcccaatcccaaactcgatccgatccatcccccatatctctccgttcatattgattcctcgtggcacctagctatctatcaaagtattttatgtatctcccaactacttagcatacatcattcattcaaaatcttttgagaaaaaaaaggtggatcatcgaagacatgggaaacggccactcccacccgaaacatcggcggagaaaagacaaggacccgatgacttcagaacagcttcttggcctgaatcagctgattcgtcagccatcgttacggctcttagtcaagtgataggcagcgatgatcagcagctcattggtttcccacaatcatcggcgc

SEQ ID NO: 25962 - DNA, 287 bp, Gossypium hirsutum
  Clone ID: LIB3272-058-P1-K1-G7
ctcttttactcattcattctttagtttcaatatgaaagcaaaaatggcttgttattgtaatgtggctacaatggctttactggcttgttaggtgttgaactccttggtttttgttgcccatggtggtgacttttaccaggatttcaacctaacatggggtgacaaaagaggtatgatattcaatggtggcaggctcttgtctttgtttatagacaggttttcagggtctgggtttaaatacaagaaagagtatttgtgtggaaggattgatatgcaactcatgcttg

SEQ ID NO: 25963 - DNA, 422 bp, Gossypium hirsutum
  Clone ID: LIB3272-058-P1-K1-G8
atttagttttctcttcctccaattaagatgcagatcttcgttaagaccctgaccggcaagaccatcaccctcgaagtcgagagttccgacacgatcgacaacgttaaggcgaaaatccaagacaaggaagggatcccaccagaccaacaacgtctcatcttcgccggaaaacagctcgaagatggccggaccttggccgattacaacatccagaaggagtccaccctccatctcgtcctccgtctacgtggtggcatgcagatcttcgtcaaaaccctgaccggcaagaccataactttggaagtcgaaagctctgacaccattgacaacgtcaaggccaagatccaagacaaggaaggcatcccaccagaccagcaaaggctcatctttgccgggaaacaactcgaggacggtcgcacctt

SEQ ID NO: 25964 - DNA, 422 bp, Gossypium hirsutum
  Clone ID: LIB3272-058-P1-K1-G9
cttcgaagtcgtagctttggaagcatggacttcatagctactatcctgtttctagctcttgtcatctcctccaccaaagctttggacccttgcggccctcagccagatgactcggaccttttggtcatcccaatctatggcaaatgttcaccattcaacccacccaaacctgactcatcgttcaacacagtcatgaacatggcatcaaaagacccagcaagggtcaagtacttgtcgagccttgtagcccaaaagaccactgcggttcccattgcttcaggccaacaagtcctaaacattggcaactatatcgtccgggtaaagattggcactccgggtcagctcatgttcatggtattggacactagcaatgatgtggcttgggtcccatgctccggctgcaacgggtgctcagccaccac

SEQ ID NO: 25965 - DNA, 411 bp, Gossypium hirsutum
  Clone ID: LIB3272-058-P1-K1-H1
caacaatggtggagaaggtgtatggcccagcctttgctattccaacgcgagtgattgcatgtcttattgaaaaggccattgaattcgagactggccctgtcgatctgcttaaaggagagcacaaagaccctgaatttctcaagctccagccttttgcaacagttcctgtcactcaagatggatattatgttttatatgaatcccgtgcaatcataaggtactatgcagaaaaatgcagatcacaagggactgatctactgggaaagacagtagaggaaaggggacaagagcaaaatatggctagaagttgaggcacacaatttccacccatcaatttacgccttgaccctacatgtgatgtttgcttgcaagaatgggttccctcctgatgaaaatttggtcaaggcaagc

SEQ ID NO: 25966 - DNA, 414 bp, Gossypium hirsutum
  Clone ID: LIB3272-058-P1-K1-H10
caaaccatgtggttggccatctaattgggagctttgctttcattgtctttgacaaatccacctccactttgtttgtggcttctgatcaatttggtaaggttcctctctattggggaatcaccgccgacggatatgtggcctttgctgataatgctgaattgctgaaaggtgcctgtggcaaatctcctgcttcttttcctcaaggctgtttctactccacagcagtaggaggattaagaagctatgagaatcctaagaacaagatcactgcagtgcctgctgaagaagaggagatatggggtgctaaattcaaggtggaagggccaacagttgttgctgccacagagtagtcctttgctttctccttctaaatctatggatccatgggaatataggagctgcaaatgcatagca

SEQ ID NO: 25967 - DNA, 410 bp, Gossypium hirsutum
  Clone ID: LIB3272-058-P1-K1-H11
agaaattatcagggttgccacctgagactgtgttccagccattgctcaaggataatcttgtggcaaaagggctagttctttcattcatgacagacttcttcaaggactatctggtggataatagccttgatgatttaatttctcttctgaagcgagggaaaattgaggatgatctcctgcagtttttcccctccacaaagcgatctgctgaaggtttctctgagcattttaccaaggcagggttggtacccttggttgaatacaatgagaaaaaaaatatttgaggtaaaattgaaggaaatgaagtctgctttgacaacacagatagtagaggaatctgatatgtctgaagtcattgaaactgtcaaacaacgtgttaaagatgctaaattacctgatattgaggttat

SEQ ID NO: 25968 - DNA, 441 bp, Gossypium hirsutum
  Clone ID: LIB3272-058-P1-K1-H12
cccggaccgacccacgcgtgcgaacacattccattgatttttacggcgaaaaaaagaggaaaaggaaaacgaagaaaatggcgtccctctctgcccaaatccctctctgcttggccttaatgatggctgcctgtttgatgataggcatcaatggaagcatagatggagctcagagggagttcgattactttgctttgtctcttcaatggcccggcaccatctgccacaagactcgccattgctgctcctccaatgcctgctgccgaggctcgaactctccaactgaatttaccattcatggattgtggccggattataatgatggaacctggccttcctgttgttaccgatctcagtttgatgtcaaagagatttcaacattgcttgatgcacttgagaagtactggccatcgttatattgtggcaaatcatcaacctgct

SEQ ID NO: 25969 - DNA, 421 bp, Gossypium hirsutum
  Clone ID: LIB3272-058-P1-K1-H2
taaaacctttcgaaaaagagggaaaagaaaaaagcggtcgagattttcacagccatggcgagcaccaaagtacagaggattatgacccaacccatcaacctgatcttcaggtttctccaaagtaaagctcgcattcagatttggcttttcgagcagaaagatttgaggattgaaggccgaatcattggttttgacgagtacatgaatttagttcttgatgatgctgaagaagttaacgtcaagaagaaaagccgaaagtcattaggaaggattcttcttaaaggagacaacattactcttatgatgaatagtggaaaatgattgtagatccagcagttatttggactcgtgaatgcaaaatcttcttgtcatcgtataggtcaatctactatgacaatatcgtgctatctttaaaaacatg

SEQ ID NO: 25970 - DNA, 426 bp, Gossypium hirsutum
  Clone ID: LIB3272-058-P1-K1-H3
tgcactcactgggtctctctgtgtactgtcttccccttttccatttctcgtaaacaaagtccataacattcgtctctcagatcctttcctcttagatcatcaaatccattcctttttttcaccaaaacatgagggaaatcataagcattcatataggtcaagctggtattcaagtcggtaactcatgttgggagctttactgccttgaacatgaaatccaacccgatggaatgatgcccagtgacacctctgtaggtgtagcaaatgatgctttcaacactttctttagtgaaactggttcagggaaacatgttcctagagctgtgtttgtggatctggaacctactgtgatcgatgaagttaggactgggacttaccgacaacttttccaccctgaacagcttatttctggcaaagaagatgctg

SEQ ID NO: 25971 - DNA, 424 bp, Gossypium hirsutum
  Clone ID: LIB3272-058-P1-K1-H4
ggaaagctggacaccgagcaagagagtgcactgcacccccaatgccacccggggacgttaggttatgcaataattgctacaagtctggacatatagcagctgactgcacaaatgacaaggcatgcaactgtaggagaccaggtcacttggcacgggagtgtacaaatgatccaatttgcaacttgtgcaacgtagccggacatgtggctaggcattgccctaaaggcaacatgataggtgagcgaggcagttttggtggtggtggtggtggtagtggtagtcgtggcggtggctatcgagatcatcatcatagagatgtagtgtgccgtaactgccatcaattcggtcatataagccgggattgcatgggaccgttgatgatctgtcacaactgtggtggaagaggacacatggcatatgagtg

SEQ ID NO: 25972 - DNA, 420 bp, Gossypium hirsutum
  Clone ID: LIB3272-058-P1-K1-H5
gcacttggttttgcgacttcgaggagggatgcagatatttgttaagaccttgactggtaaaaccatcaccctggaggtcgagagctcggacaccattgacaatgttaaagcgaaaattcaggacaaggaggggattcctccagaccagcagaggttgatttttgccggaaagcagcttgaggatgggaggacacttgcggactataacattcaaaaggaatccaccctgcatttggttttgcgccttagaggagggatgcagatattcgtgaagactttgactgggaaaaccatcaccctggaggtggagagctcggacacgattgacaatgtgaaagctaagattcaagacaaggaggggattcctccagaccagcagaggttgatctttgctgggaaagcagtggaggatggtcgaac

SEQ ID NO: 25973 - DNA, 405 bp, Gossypium hirsutum
  Clone ID: LIB3272-058-P1-K1-H6
tgctaacacagccagaggggaggagccagataagaaaaactaaaggaaaattgttttctggttcaaaaccacagccctaatccacatgcggttcggatccggattctctaagatccggttgacattcatcgctttaattttcattctgatctgatcccaaacgaatctattcggccgtgaaaaatgacgcgtcgctgctcacattgcagccacaacggccacaactctcggacatgtccgaaccgaggggtcaaactcttcggagtccgcttgactgacgggtcgattcggaagagcgccagtatgggcaacttaagccaatattccgggtcgaattctggcgcgcataacgggaacgggtcgggttccgccggtgagggtccggatcacaccgatggttatgct

SEQ ID NO: 25974 - DNA, 424 bp, Gossypium hirsutum
  Clone ID: LIB3272-058-P1-K1-H7
tgccgtcatggcggctctctccactgttccacacctacagatccactgctcaaagaccgagtcagactcagttcataaacccattactttcccttcaaaaacaataagacccatcatccatgtcccgagaaaactggtcttttccccaaagagtgtcgacgataagatctcaaacagcaatttccttgccaatggacccgttccttcaactccaactcgttcaaaggtgaggcggcatacgatttcggtgtttgttggggatgaaagtgggatgattaataggattgctggagtttttgctagacgagggtataatattgagtcacttgcggttggtttaaataaagataaggcactttttaccattgttgtgtctggtactgatagagtgcttcagcaagttgtggagcagttacaaaagctt

SEQ ID NO: 25975 - DNA, 414 bp, Gossypium hirsutum
  Clone ID: LIB3272-058-P1-K1-H8
ctcgtgatagtgctccttccatcatattcattgatgaaatagattccttgtgtggtcagcgaggtgagggcaacgagagtgaagcatcaagacgtatcaaaactgaacttcttgtgcagatgcagggtgttggacatagtgatcagaaagtcttagtgcttgcagcaacgaatactccctatgctcttgatcaggccatccgccgccgttttgataagcgtatttacattcctctccctgatttgaaggctcgacaacatatgttctttttgaacctgttcgtaaaacccaagatgcaatgtttttctacaagacgcctaatgacatgtggatgccatgtggacccaagcaagcaggtgttgtccaaatcactatgcaagaattggcagccaaaggacttgcagcacaggttct

SEQ ID NO: 25976 - DNA, 367 bp, Gossypium hirsutum
  Clone ID: LIB3272-058-P1-K1-H9
gcccgatccaaaacgtggttttttgataaaaaaaccacctaacatgggggaaaacaagatggctttcctgcatgaaccatggctagtggagaacgggttgatagggatctagcagggagattcgccatggcaggactgtacacaacatgtcgacttcctcattgcggaaaaaaccggacctgacgctagtttccaaggttctgcttgcaaagcttatgcagttcctctcccaacttcaagaggtgatattttggaccaagctctgcgatctctttcctgctatttcatcggccattgttgctgagtggtatggctattgaagaccatcggtgtttgcgttaagttcactatgacttacaccattggg

SEQ ID NO: 25977 - DNA, 446 bp, Gossypium hirsutum
  unsure (1)..(446): unsure at all n locations
  Clone ID: LIB3272-035-P1-K1-D12-F2A
aaccccaaactttccttccttatttttcttcattaataaaagctggaaacgaaatgaagctaagagagaggaacaaagaaggtaaaaaagaaaacacttagaagactgaagacagttccatcatctgattcatctcttctacttgacctgaagaactctcatcaaaaagccacttctcaagaaacgataatggcggattattcttattattgttgttgttgggatgatcaactttttgcttcttataattctctggggccattgcaacattgaccttgtnaccaccaccaccaccaccatnatnatcatcatcatcatcatcaccatcatcgtcatttcctgaatcttgacaagcaccctttgatgtagattcacaagtagacttgtcccatacaacattgttaatgttctcaaacgataaaatcgacttaaactcttcatgggag

SEQ ID NO: 25978 - DNA, 457 bp, Gossypium hirsutum
  Clone ID: LIB3272-035-P1-K1-D12-R2A
agaaaacccttttctaagggcatctctctctctctctctctctcttttacttatataccactcacatggctctatcactatttcaaaactccatagctgaataataataaaacggcttggaagaaaagccatgggaagacctccttgctgtgataaagttggtatcaagaaaggtccatggacccctgaggaagatatcatacttgtctcttacatccaacaacatggtccagggaattggagatcagtacccactaatactgggttattgagatgcagcaaaagttgcaggcttcgatggactaattatctgagaacaggcatcaagcgagggaacttcactcctcatgaagaaggcatgataattcacttgcaagctttattgggtaacaaatgggcagcaattgcttcatacctaccacaaaggacagataatgatataaagaactactggaac
